United States Patent
Gantier et al.

(10) Patent No.: US 7,650,243 B2
(45) Date of Patent: Jan. 19, 2010

(54) RATIONAL EVOLUTION OF CYTOKINES FOR HIGHER STABILITY, THE CYTOKINES AND ENCODING NUCLEIC ACID MOLECULES

(75) Inventors: Rene Gantier, Elancourt (FR); Manuel Vega, Vigneux-sur-Seine (FR); Lila Drittanti, Vigneux-sur-Seine (FR); Thierry Guyon, Palaiseau (FR)

(73) Assignee: Hanall Pharmaceutical Co., Ltd., Daejeon (KR)

( * ) Notice: Subject to any disclaimer, the term of this patent is extended or adjusted under 35 U.S.C. 154(b) by 0 days.

(21) Appl. No.: 11/707,014

(22) Filed: Feb. 14, 2007

(65) Prior Publication Data

US 2007/0224665 A1 Sep. 27, 2007

Related U.S. Application Data

(62) Division of application No. 10/658,834, filed on Sep. 8, 2003.

(60) Provisional application No. 60/457,135, filed on Mar. 21, 2003, provisional application No. 60/409,898, filed on Sep. 9, 2002.

(51) Int. Cl.
G01N 33/48 (2006.01)
(52) U.S. Cl. ...................................... 702/19
(58) Field of Classification Search .................. 702/19
See application file for complete search history.

(56) References Cited

U.S. PATENT DOCUMENTS

| | | | |
|---|---|---|---|
| 4,044,126 A | 8/1977 | Cook et al. | 514/180 |
| 4,364,923 A | 12/1982 | Cook et al. | 424/46 |
| 4,414,209 A | 11/1983 | Cook et al. | 514/180 |
| 4,522,811 A | 6/1985 | Eppstein et al. | 514/2 |
| 5,096,815 A | 3/1992 | Ladner et al. | 435/69.1 |
| 5,223,409 A | 6/1993 | Ladner et al. | 435/69.7 |
| 5,571,698 A | 11/1996 | Ladner et al. | 435/69.7 |
| 5,723,323 A | 3/1998 | Kauffman et al. | 435/172.3 |
| 5,763,239 A | 6/1998 | Short et al. | 435/172.1 |
| 5,798,208 A | 8/1998 | Crea | 435/6 |
| 5,837,500 A | 11/1998 | Ladner et al. | 435/69.7 |
| 5,862,514 A | 1/1999 | Huse et al. | 702/22 |
| 5,925,565 A | 7/1999 | Berlioz et al. | 435/325 |
| 6,001,574 A | 12/1999 | Short et al. | 435/6 |
| 6,013,478 A | 1/2000 | Wells et al. | 435/69.1 |
| 6,057,103 A | 5/2000 | Short | 435/6 |
| 6,096,548 A | 8/2000 | Stemmer | 435/440 |
| 6,117,679 A | 9/2000 | Stemmer | 435/440 |
| 6,132,970 A | 10/2000 | Stemmer | 435/6 |
| 6,156,509 A | 12/2000 | Schellenberger | 435/6 |
| 6,165,793 A | 12/2000 | Stemmer | 435/440 |
| 6,171,820 B1 | 1/2001 | Short | 435/69.1 |
| 6,174,673 B1 | 1/2001 | Short et al. | 435/6 |
| 6,180,406 B1 | 1/2001 | Stemmer | 435/440 |
| 6,238,884 B1 | 5/2001 | Short et al. | 435/69.1 |
| 6,548,640 B1 | 4/2003 | Winter | 530/387.1 |
| 2002/0081574 A1 | 6/2002 | Collett et al. | 435/5 |
| 2003/0129203 A1 | 7/2003 | Vega et al. | 424/233.1 |
| 2003/0129584 A1 | 7/2003 | Vega et al. | 435/5 |
| 2003/0134351 A1 | 7/2003 | Vega et al. | 435/69.1 |
| 2003/0175694 A1 | 9/2003 | Vega | 435/5 |
| 2003/0224404 A1 | 12/2003 | Vega et al. | 435/6 |
| 2004/0132977 A1 | 7/2004 | Gantier et al. | 530/351 |
| 2005/0202438 A1 | 9/2005 | Gantier et al. | 435/6 |
| 2006/0020116 A1 | 1/2006 | Gantier et al. | 530/351 |
| 2006/0020396 A1 | 1/2006 | Gantier et al. | 702/19 |
| 2006/0094655 A1 | 5/2006 | Guyon et al. | 514/12 |
| 2006/0195268 A1 | 8/2006 | Vega | 702/19 |
| 2006/0247170 A1 | 11/2006 | Guyon et al. | 514/12 |
| 2006/0251619 A1 | 11/2006 | Borrelly et al. | 424/85.6 |
| 2007/0016380 A1 | 1/2007 | Smythe et al. | 702/19 |
| 2007/0172459 A1 | 7/2007 | Gantier et al. | 424/85.5 |
| 2007/0224665 A1 | 9/2007 | Gantier et al. | 435/69.51 |
| 2007/0249532 A9 | 10/2007 | Guyon et al. | 514/12 |
| 2007/0254838 A1 | 11/2007 | Gantier et al. | 514/12 |

FOREIGN PATENT DOCUMENTS

| | | |
|---|---|---|
| EP | 1022335 | 7/2000 |
| WO | 95/23813 | 9/1995 |
| WO | 98/13487 | 4/1998 |
| WO | 01/25438 | 4/2001 |
| WO | 01/32711 | 5/2001 |
| WO | 01/32844 | 5/2001 |
| WO | 01/44809 | 6/2001 |
| WO | 01/61344 | 8/2001 |
| WO | 01/86291 | 11/2001 |
| WO | 02/16606 | 2/2002 |
| WO | 03/023032 | 3/2003 |
| WO | 2006/024547 | 3/2006 |

OTHER PUBLICATIONS

Tomii et al., "Analysis of Amino Acid Indices and Mutation Matrices for Sequence Comparison and Structure Prediction of Proteins," Protein Engineering (1996) vol. 9, No. 1, pp. 27-36.*
Hibbert, L., and G.R. Foster, "Human type 1 inderferons differ greatly in their effects on the proliferation of primary B cells," Journal of Interferon and Cytokine Research, 19:309-318, (1999).
Holm, L. and C. Sander, "Mapping the Protein Universe," Science, 273:595-602, (1996).
IUPAC-IUB, "Commission on biochemical nomenclature a one-letter notation for amino acid sequences tentative rules," Journal of Biological Chemistry, 243(13):3557-3559, (1968).
IUPAC-IUB, "Commission on biochemical nomenclature abbreviated nomenclature of synthetic polypeptides (Polymerized Amino Acids)," Biochemistry, 11:942-944, (1972).

(Continued)

*Primary Examiner*—Jerry Lin
(74) *Attorney, Agent, or Firm*—K & L Gates LLP; Stephanie Seidman

(57) ABSTRACT

Compositions of modified cytokines and uses thereof generated using processes and systems for the high throughput directed evolution of peptides and proteins, particularly cytokines that act in complex biological settings, are provided. Also provided are modified cytokines formulated for oral delivery and uses thereof to treat diseases and conditions mediated by cytokines.

19 Claims, 57 Drawing Sheets

OTHER PUBLICATIONS

Johnson, M.S. and J.P. Overington, "A structural basis for sequence comparisons. An evaluation of scoring methodologies," Journal of Molecular Biology, 233:716-738, (1993).
Jones, D.T., et al., "The rapid generation of mutation data matrics from protein sequences," Computer Applications in the Biosciences, 8:275-282, (1992).
Lu, G., et al., "TOP: a new method for protein structure comparisons and similarity searches," Journal of applied crystallography., 33:176-189, (2000).
Manetti, F., et al. "Design and realization of a tailor-made enzyme to modify the molecular recognition of 2-arylpropionic esters by Candida rugosa lipase," Biochemica et Biophysica Acta, 1543(1):146-158, (2000).
Marrack, P., et al., "Type I interferons keep activated T cells alive," Journal of Experimental Medicine, 189:521-530, (1999).
Martin, Paul, "Beyond the next generation of therapeutic proteins," Online Article Oct. 2006, http://www.biotech-online.com/artimg/a20062123243425.PDF (accessed on Jan. 11, 2007) (3 pages).
Martin, Paul, "Next generation products and prospects for the oral delivery of proteins" (Meeting Abstract) Fourth Annual Protein Process Development (Jan. 11, 2007), http://www.chi-peptalk.com/06_Ppd.asp.
Martin, Paul, "The market for therapeutic proteins: new business opportunities," (Meeting Abstract) Second Annual Advancing Protein Therapeutics, Engineering the Next Generation of Proteins for Therapeutics, (Jan. 13, 2006), http://www.chi-peptalk.com/pttn2006.asp.
McLachlan, A.D., "Tests for comparing related amino-acid sequences. Cytochrome c and Cytochrome c551," Journal of Molecular Biology, 61:409-424, (1971).
Media Release: "Nautilus biotech: 'Next Generation Biopharmaceuticals (NGB)'" Paris, France, Jun. 21, 2004, http://www.prnewswire.co.uk/cgi/news/release?id=125241 (accessed on Jan. 8, 2007) (1 page).
Miyata, T., "Two types of amino acid substitutions in protein evolution," Journal of Molecular Evolution, 12:219-236, (1979).
Morikawa, K., et al., "Recombinant interferon-α, -β and -γ enhance the proliferative response of human B cells," Journal of Immunology, 139:761-766, (1987).
Murzin, A.G., et al., "SCOP: A structural classification of proteins database for the investigation of sequences and structures," Journal of Molecular Biology, 247:536-540, (1995).
Needleman, S. and C. Wunsch, "A general method applicable to the search for similarities in the amino acid sequence of two proteins," Journal of Molecular Biology, 48:443-453, (1970).
Orengo, C.A., et al., "CATH—a hierarchic classification of protein domain structures," Structure, 5(8):1093-1108, (1997).
Pearson, W.R. and D.J. Lipman, "Improved tools for biological sequence comparison," Proceedings of the National Academy of Sciences of the United States of America, 85:2444-2448, (1988).
Pestka, S., et al., "Interferons and their actions," Annual Review of Biochemistry, 56:727-777, (1987).
Piehler, J., et al., "New structural and functional aspects of the Type I interferon-receptor interaction revealed by comprehensive mutational analysis of the binding interface," Journal of Biological Chemistry, 275:40425-40433, (2000).
Rao, J.K., "New scoring matrix for amino acid residue exchanges based on residue characteristic physical parameters," Journal of Peptide and Protein Research, 29:276-281, (1987).
Risler, J.L., et al., "Amino acid substitutions in structurally related proteins A pattern recognition approach," Journal of Molecular Biology, 204:1019-1029, (1988).
Robert, K.H., et al., "Interferon induces proliferation in leukemic and normal B-cell subsets," Hematological Oncology, 4:113-120, (1986).
Roisman, L.C., et al., "Structure of the interferon-receptor complex determined by distance constraints from double-mutant cycles and flexible docking," Proceedings of the National Academy of Sciences of the United States of America, 98:13231-13236, (2001).
Sali, A. and T.L. Blundell, "Definition of general topological equivalence in protein structures," Journal of Molecular Biology, 212:403-428, (1990).
Scheel-Toellner, D., et al., "Inhibition of T cell apoptosis by IFN-β rapidly reverses nuclear translocation of protein kinase C-δ," European Journal of Immunology, 29:2603-2612, (1999).
Schwartz, R.M. and M.O. Dayhoff, "Matrices for detecting distant relationships," Atlas of Protein Sequence and Structure, National Biomedical Research Foundation, pp. 353-358, (1978).
Shindyalov, I.N. and P.E. Bourne, "Protein structure alignment by incremental combinatorial extension (CE) of the optimal path," Protein Engineering, 11(9):739-747, (1998).
Smith, T.F. and M.S. Waterman, "Comparison of Biosequences", Advances in Applied Mathematics, 2:482-489, (1981).
Stark, G.R., et al., "How cells respond to interferons," Annual Review of Biochemistry, 67:227-264, (1998).
Vega, Manuel, "Improving the delivery and pharmakokinetics of therapeutic proteins by increased resistance to proteolysis," (Meeting Abstract) Second Annual Advancing Protein Therapeutics, Engineering the Next Generation of Proteins for Therapeutics, (Jan. 12, 2006), http://www.chi-peptalk.com/pttn2006.asp.
Vega, Manuel, "Next-generation protein therapeutics for oral delivery," (Meeting Abstract) Third Annual Optimizing Protein and Antibody Therapeutics, Pioneering New Frontiers (Jan. 9, 2007) http://www.chi-peptalk.com/06_PTT.asp.
Xiao et al., "Construction and screening of a multi-point site-specific mutant library of subtilisin E with a set of oligonucleotides," Science in China (Series C), 40(4):337-344, (1997).
Alam et al., "Expression and purification of a mutant human growth hormone that is resistant to proteolytic cleavage by thrombin, plasmin and human plasma in vitro," Journal of Biotechnology 65:183-190 (1998).
Blazquez et al., "Single amino acid replacements at positions altered in naturally occurring extended-spectrum TEM beta-lactamases," Antimicrobial Agents and Chemotherapy 39:145-149 (1995).
Chiang et al., "In vivo genetic analysis of bacterial virulence" Annual Reviews of Microbiology 53:129-154 (1999).
Kim, S. and H. Moon, "Purification and characterization of intracellular and extracellular inulase from Kluyveromyces marxiaus," Agricultural Chemistry and Biotechnology 30:169-178 (1987) (English Abstract on first page of article).
Lewerenz et al., "Shared receptor components but distinct complexes for alpha and beta interferons" Journal of Molecular Biology 282(3):585-599 (1998).
Persson et al., "Virus-receptor interaction in the adenovirus system: characterization of the positive cooperative binding of virions on HeLa cells," Journal of Virology 54:92-97 (1985).
Stabach et al., "Site-directed mutagenesis of alpha II spectrin at codon 1175 modulates its mu-calpain susceptibility," Biochemistry 36:57-65 (1997).
Zlauddin et al., "Microarrays of cells expressing defined cDNAs," Nature 411:107-110 (2001).
Certified English Translation of PCT Patent Application No. WO 01/44809, "Methods for Screening or Assessing the Performance of a Collection of Biological Agents in Living Target Cells, and their Applications," (2001).
Certified English Translation of PCT Patent Application No. WO 01/86291, "Method for Determining the Titer of Biological Agents in Living Target Cells," (2001).
Certified English Translation of PCT Patent Application No. WO 02/16606, "Method for Massive Directed Mutagenesis," (2002).
Burgess et al., "DISSiMiL: Diverse Small Size Mini-Libraries applied to simple and rapid epitope mapping of a monoclonal antibody," Jornal of Peptide Research 57:68-76 (2001).

* cited by examiner

Amino acid sequence of human mature IFNα-2b

```
         1         10        20        30        40        50
         .         .         .         .         .         .
IFNα-2b  CDLPQTHSLGSRRTLMLLAQMRRISLFSCLKDRHDFGFPQEEFGNQFQKA 51        60        70        80        90       100
         .         .         .         .         .         .
IFNα-2b  ETIPVLHEMIQQIFNLFSTKDSSAAWDETLLDKFYTELYQQLNDLEACVI 101       110       120       130       140       150
         .         .         .         .         .         .
IFNα-2b  QGVGVTETPLMKEDSILAVRKYFQRITLYLKEKKYSPCAWEVVRAEIMRS 151       160
         .         .
IFNα-2b  FSLSTNLQESLRSKE
```

Scores from PAM250, given to residue substitutions to protect human INF α-2b against proteolysis

|   | R | D | E | L | K | M | F | P | W | Y |
|---|---|---|---|---|---|---|---|---|---|---|
| A | -2 | 0 | 0 | -2 | -1 | -1 | -3 | 1 | -6 | -3 |
| N | 0 | 2 | 1 | -3 | 1 | -2 | -3 | 0 | -4 | -2 |
| C | -4 | -5 | -5 | -6 | -5 | -5 | -4 | -3 | -8 | 0 |
| Q | 1 | 2 | 2 | -2 | 1 | -1 | -5 | 0 | -5 | -4 |
| G | -3 | 1 | 0 | -4 | -2 | -3 | -5 | 0 | -7 | -5 |
| H | 2 | 1 | 1 | -2 | 0 | -2 | -2 | 0 | -3 | 0 |
| I | -2 | -2 | -2 | 2 | -2 | 2 | 1 | -2 | -5 | -1 |
| S | 0 | 0 | 0 | -3 | 0 | -2 | -3 | 1 | -2 | -3 |
| T | -1 | 0 | 0 | -2 | 0 | -1 | -3 | 0 | -5 | -3 |
| V | -2 | -2 | -2 | 2 | -2 | 2 | -1 | -1 | -6 | -2 |

Treatment with chymotrypsin

Treatment with protease mixture

Treatment with blood lysate

Treatment with serum

Potency (antiproliferation) – IFNα leads

| | Potency (10⁸ U/mg) |
|---|---|
| WT | 1,70 |
| Lead 13 | 1,60 |
| Lead 9 | 1,90 |
| Lead 8 | 2,05 |
| Lead 2 | 3,70 |
| Lead 16 | 1,60 |
| Lead 4 | 0,50 |
| Lead 5 | 0,65 |
| Lead 15 | 3,20 |
| Lead 10 | 0,50 |
| Lead 12 | 1,50 |
| Lead 11 | nd |
| Lead 6 | 1,20 |
| Lead 1 | 2,95 |
| Lead 7 | 1,60 |
| Lead 3 | 2,25 |
| Lead 14 | nd |

FIG. 6H

FIGURE 6J
IFN-α LEADS

| IFN-α LEAD | SEQ ID N° | Mutation(s) |
|---|---|---|
| 1 | 983 | K121Q / P109A |
| 2 | 987 | E159H / Y89H |
| 3 | 124 | E159Q |
| 4 | 90 | E58H |
| 5 | 89 | E58Q |
| 6 | 979 | E41H / Y89H / N45D |
| 7 | 103 | L117I |
| 8 | 986 | R125H / M111V |
| 9 | 96 | E107H |
| 10 | 101 | E113H |
| 11 | 87 | E41Q |
| 12 | 107 | R125Q |
| 13 | 985 | L117V / A139G |
| 14 | 980 | E41Q / D94G |
| 15 | 93 | E78H |
| 16 | 984 | K133Q / K121Q / P109A / G102R |

Summary – IFNα leads

| | Potency (AV) (10⁸ U/mg) | Potency (AP) (10⁸ U/mg) | AUC (arbitrary units) |
|---|---|---|---|
| WT | 1,6 | 1,7 | 16,5 |
| Pegasys | | | 33,0 |
| Pegasys | | | 77,0 |
| Lead 13 | 0,4 | 1,6 | 129,7 |
| Lead 9 | 1,2 | 1,9 | 109,0 |
| Lead 8 | 1,0 | 2,1 | 107,0 |
| Lead 2 | 2,1 | 3,7 | 105,0 |
| Lead 16 | 0,8 | 1,6 | 101,6 |
| Lead 4 | 4,3 | 0,5 | 100,0 |
| Lead 5 | 1,2 | 0,7 | 88,6 |
| Lead 15 | 1,7 | 3,2 | 88,0 |
| Lead 10 | 5,5 | 0,5 | 85,6 |
| Lead 12 | 1,4 | 1,5 | 77,0 |
| Lead 11 | 23,5 | nd | 69,0 |
| Lead 6 | 1,7 | 1,2 | 64,2 |
| Lead 1 | 1,9 | 3,0 | 58,5 |
| Lead 7 | 1,7 | 1,6 | 56,5 |
| Lead 3 | 1,7 | 2,3 | 54,6 |
| Lead 14 | 0,9 | nd | 25,0 |

FIG. 6T

IFNα LEADS– Area under the curve (AUC)

| | AUC (arbitrary units) | protein injected (µg/ml*) | IFN units injected / ml (x10⁶) |
|---|---|---|---|
| WT | 16,5 | 2,5 | 2,0 |
| Pegasys | 33,0 | 18,0 | |
| Pegasys | 77,0 | 36,0 | |
| Lead 13 | 129,7 | 10,3 | 2,0 |
| Lead 9 | 109,0 | 3,5 | 2,0 |
| Lead 8 | 107,0 | 4,2 | 2,0 |
| Lead 2 | 105,0 | 2,0 | 2,0 |
| Lead 16 | 101,6 | 5,4 | 2,0 |
| Lead 4 | 100,0 | 1,0 | 2,0 |
| Lead 5 | 88,6 | 3,6 | 2,0 |
| Lead 15 | 88,0 | 2,4 | 2,0 |
| Lead 10 | 85,6 | 1,0 | 2,0 |
| Lead 12 | 77,0 | 3,0 | 2,0 |
| Lead 11 | 69,0 | 0,2 | 2,0 |
| Lead 6 | 64,2 | 3,4 | 2,0 |
| Lead 1 | 58,5 | 2,1 | 2,0 |
| Lead 7 | 56,5 | 2,4 | 2,0 |
| Lead 3 | 54,6 | 2,5 | 2,0 |
| Lead 14 | 25,0 | 2,0 | 2,0 |

FIG. 6U

Interferon α-2b structure in "space filling" representation

FIG.8A

Cytokine regions susceptible to protease attack identified by structural alignment with Lead mutants of IFN α-2b IFN-α2b Correlation between antiviral and cell proliferation activities for alanine scanning of interferon α-2b

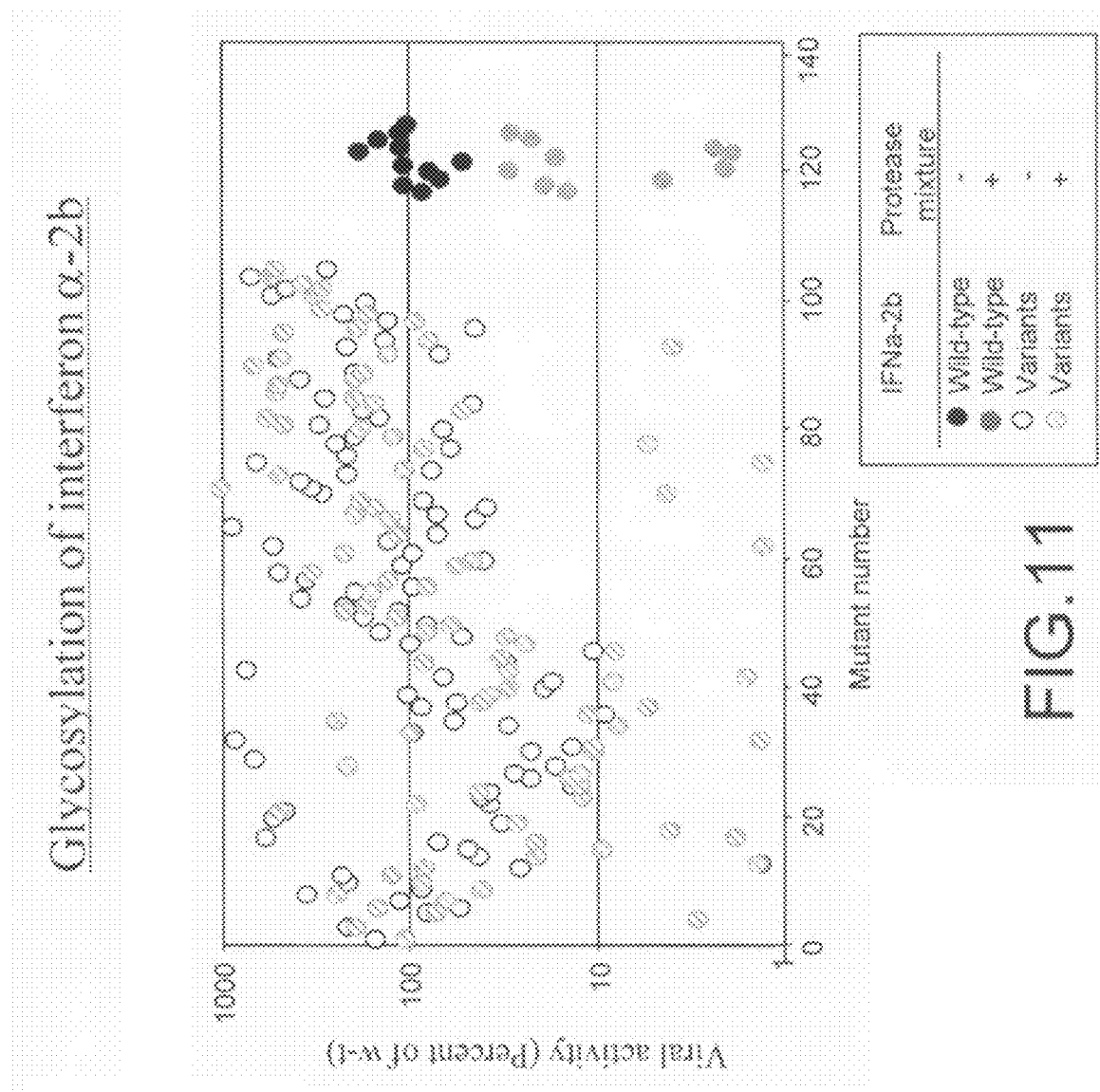

Interferon-beta

Protection against proteolysis

Sequence:

MSYNLLGFLQRSSNFQCQKLLWQLNGRLEYCLKDRMNFDIPEEIKQLQQFQKEDAALTI

YEMLQNIFAIFRQDSSTGWNETIVENLLANVYHQINHLKTVLEEKLEKEDFTRGKLMS

SLHLKRYYGRILHYLKAKEYSHCAWTIVRVEILRNFYFINRLTGYLRN

Exposed residues:

----------------------------------------D--E--KQLQQ-QK-------

----Q--FA--RQD-SS-G-NET-----------------------EKEDF-R--L--

SLH-KR--GR-LH--KAKE------------------------Y-RN

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | | | |
|---|---|---|---|---|---|---|---|
| 1. | D39Q | 16. | D73Q | 31. | F111I | 46. | L130I |
| 2. | D39N | 17. | D73N | 32. | F111V | 47. | K134Q |
| 3. | E42Q | 18. | E81Q | 33. | R113H | 48. | K134N |
| 4. | E42N | 19. | E81N | 34. | R113Q | 49. | K136Q |
| 5. | E42H | 20. | E81H | 35. | L116V | 50. | K136N |
| 6. | K45Q | 21. | E107Q | 36. | L116I | 51. | E137Q |
| 7. | K45N | 22. | E107N | 37. | L120V | 52. | E137N |
| 8. | L47V | 23. | E107H | 38. | L120I | 53. | E137H |
| 9. | L47I | 24. | K108Q | 39. | K123Q | 54. | Y163H |
| 10. | K52Q | 25. | K108N | 40. | K123N | 55. | Y163I |
| 11. | K52N | 26. | E109Q | 41. | R124H | 56. | R165H |
| 12. | F67I | 27. | E109N | 42. | R124Q | 57. | R165Q |
| 13. | F67V | 28. | E109H | 43. | R128H | | |
| 14. | R71H | 29. | D110Q | 44. | R128Q | | |
| 15. | R71Q | 30. | D110N | 45. | L130V | | |

FIG. 12A

Interferon-gamma

Protection against proteolysis

Sequence:

CYCQDPYVKEAENLKKYFNAGHSDVADNGTLFLGILKNWKEESDRKIMQSQIVSFYFKL

FKNFKDDQSIQKSVETIKEDMNVKFFNSNKKKRDDFEKLTN

Exposed residues:

------------------------------T--L---KN-KEE--------------K-

-KN-KDDQS--------------------------

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | |
|---|---|---|---|---|
| 1. | L33V | | 12. | E42H |
| 2. | L33I | | 13. | K58Q |
| 3. | K37Q | | 14. | K58N |
| 4. | K37N | | 15. | K61Q |
| 5. | K40Q | | 16. | K61N |
| 6. | K40N | | 17. | K64Q |
| 7. | E41Q | | 18. | K64N |
| 8. | E41N | | 19. | D65Q |
| 9. | E41H | | 20. | D65N |
| 10. | E42Q | | 21. | D66Q |
| 11. | E42N | | | |

FIG. 12B

Interleukin-10

Protection against proteolysis

Sequence:

SPGQGTQSENSCTHFPGNLPNMLRDLRDAFSRVKTFFQMKDQLDNLLLKESLLEDFKGY

LGCQALSEMIQFYLEEVMPQAENQDPDIKAHVNSLGENLKT

Exposed residues:

-------------------------------------------------KESLLEDFKGY

L------EM-QFY-EEV-PQ-ENQDPD-----------K-

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | K49Q | 18. | K57N | 35. | E75Q |
| 2. | K49N | 19. | Y59H | 36. | E75N |
| 3. | E50Q | 20. | Y59I | 37. | E75H |
| 4. | E50N | 21. | L60V | 38. | P78S |
| 5. | E50H | 22. | L60I | 39. | P78A |
| 6. | L52V | 23. | E67Q | 40. | E81Q |
| 7. | L52I | 24. | E67N | 41. | E81N |
| 8. | L53V | 25. | E67H | 42. | E81H |
| 9. | L53I | 26. | M68V | 43. | D84Q |
| 10. | E54Q | 27. | M68I | 44. | D84N |
| 11. | E54N | 28. | F71I | 45. | P85S |
| 12. | E54H | 29. | F71V | 46. | P85A |
| 13. | D55Q | 30. | Y72H | 47. | D86Q |
| 14. | D55N | 31. | Y72I | 48. | D86N |
| 15. | F56I | 32. | E74Q | 49. | K88Q |
| 16. | F56V | 33. | E74N | 50. | K88N |
| 17. | K57Q | 34. | E74H | | |

FIG. 12C

Ciliary neurotrophic factor

Protection against proteolysis

Sequence:

DSADGMPVASTDQWSELTEAERLQENLQAYRTFHVLLARLLEDQQVHFTPTEGDFHQAI

HTLLLQVAAFAYQIEELMILLEYKIPRNEADGMPINVGDGGLFEKKLWGLKVLQELSQW

TVRSIHDLRFISSHQTGIPA

Exposed residues:

```
-------VASTDQWSELT---------Q---T-HVL-AR--E--QVH--PTEGD-----
--------------------EYKIPRNE-DGMPINVGDG-L------------------
-------------------
```

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | D62Q | 16. | E92H | 31. | P135S |
| 2. | D62N | 17. | P100S | 32. | P135A |
| 3. | W64S | 18. | P100A | 33. | R136H |
| 4. | W64H | 19. | E102Q | 34. | R136Q |
| 5. | E66Q | 20. | E102N | 35. | E138Q |
| 6. | E66N | 21. | E102H | 36. | E138N |
| 7. | E66H | 22. | D104Q | 37. | E138H |
| 8. | L67V | 23. | D104N | 38. | D140Q |
| 9. | L67I | 24. | E131Q | 39. | D140N |
| 10. | L86V | 25. | E131N | 40. | P143S |
| 11. | L86I | 26. | E131H | 41. | P143A |
| 12. | R89H | 27. | Y132H | 42. | D148Q |
| 13. | R89Q | 28. | Y132I | 43. | D148N |
| 14. | E92Q | 29. | K133Q | 44. | L151V |
| 15. | E92N | 30. | K133N | 45. | L151I |

FIG. 12D

Granulocyte-colony stimulating factor

Protection against proteolysis

Sequence:

VLLGHSLGIPWAPLSSCPSQALQLAGCLSQLHSGLFLYQGLLQALEGISPELGPTLDTL

QLDVADFATTIWQQMEELGMAPALQPTQGAMPAFASAFQRRAGGVLVASHLQSFLEVSY

RVLRHLAQP

Exposed residues:

----------W-P-SS-PSQALQ----------S--F------Q--E---PE--------

------------------G-APALQPTQ-AM-A-ASAF---------------------

R--RH--QP-

Proteases:

['Trypsin', 'Endoproteinase Asp-N', 'Chymotrypsin', 'Proline endopeptidase',

'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | W61S | 12. | E96N | 23. | P135S |
| 2. | W61H | 13. | E96H | 24. | P135A |
| 3. | P63S | 14. | P100S | 25. | F147I |
| 4. | P63A | 15. | P100A | 26. | F147V |
| 5. | P68S | 16. | E101Q | 27. | R169H |
| 6. | P68A | 17. | E101N | 28. | R169Q |
| 7. | L72V | 18. | E101H | 29. | R172H |
| 8. | L72I | 19. | P131S | 30. | R172Q |
| 9. | F86I | 20. | P131A | 31. | P177S |
| 10. | F86V | 21. | L133V | 32. | P177A |
| 11. | E96Q | 22. | L133I | | |

FIG. 12E

Human growth hormone

Protection against proteolysis

Sequence:

SLCFSESIPTPSNREETQQKSNLELLRISLLLIQSWLEPVQFLRSVFANSLVYGASDSN

VYDLLKDLEEGIQTLMGRLEDGSPRTGQIFKQTYSKFDTNSHNDDALLKNYGLLYCFRK

DMDKVETFLRIVQCRSVEGSCGF

Expose residues:

------ES-PT-SNREE--------------------E--QF-RS--AN-L--------

--------------------EDG-PRT-Q--KQTY-KFD---------------------

---------------RS-EGSCG-

Proteases: ['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | E56Q | 17. | F92I | 33. | K140N |
| 2. | E56N | 18. | F92V | 34. | Y143H |
| 3. | E56H | 19. | R94H | 35. | Y143I |
| 4. | P59S | 20. | R94Q | 36. | K145Q |
| 5. | P59A | 21. | L101V | 37. | K145N |
| 6. | R64H | 22. | L101I | 38. | F146I |
| 7. | R64Q | 23. | E129Q | 39. | F146V |
| 8. | E65Q | 24. | E129N | 40. | D147Q |
| 9. | E65N | 25. | E129H | 41. | D147N |
| 10. | E65H | 26. | D130Q | 42. | R183H |
| 11. | E66Q | 27. | D130N | 43. | R183Q |
| 12. | E66N | 28. | P133S | 44. | E186Q |
| 13. | E66H | 29. | P133A | 45. | E186N |
| 14. | E88Q | 30. | R134H | 46. | E186H |
| 15. | E88N | 31. | R134Q | | |
| 16. | E88H | 32. | K140Q | | |

FIG. 12F

Interleukin-12

Protection against proteolysis

Sequence:

DITKDKTSTVEACLPLELTKNESCLNSRETSFITNGSCLASRKTSFMMALCLSSIYEDL

KMYQVEFKTMNAKLLMDPKRQIFLDQNMLAVIDELMQALNFNSETVPQKSSLEEPDFYK

TKIKLCILLHAFRIRAVTIDRVMSYLNAS

Exposed residues:

-----KT--VE----LELTKNES-LNSRETSF-TNGSCLA-RK-------------E--

KM--VE-KT-N---LM-PKR----------------------------------------

----------------------R--S--NAS-

Proteases:

['Trypsin', 'Endoproteinase Asp-N', 'Chymotrypsin', 'Proline endopeptidase', 'Staphylococcal P.']

Exclusion list:['B', 'Z', 'X', '*', 'K', 'R', 'D', 'F', 'W', 'Y', 'M', 'L', 'P', 'E']

Substitutions:

| | | | | | | | |
|---|---|---|---|---|---|---|---|
| 1. | K56Q | 15. | E72Q | 29. | R92H | 43. | K117Q |
| 2. | K56N | 16. | E72N | 30. | R92Q | 44. | K117N |
| 3. | E61Q | 17. | E72H | 31. | K93Q | 45. | L124V |
| 4. | E61N | 18. | L75V | 32. | K93N | 46. | L124I |
| 5. | E61H | 19. | L75I | 33. | E107Q | 47. | M125V |
| 6. | L66V | 20. | R78H | 34. | E107N | 48. | M125I |
| 7. | L66I | 21. | R78Q | 35. | E107H | 49. | P127S |
| 8. | E67Q | 22. | E79Q | 36. | K110Q | 50. | P127A |
| 9. | E67N | 23. | E79N | 37. | K110N | 51. | K128Q |
| 10. | E67H | 24. | E79H | 38. | M111V | 52. | K128N |
| 11. | L68V | 25. | F82I | 39. | M111I | 53. | R129H |
| 12. | L68I | 26. | F82V | 40. | E115Q | 54. | R129Q |
| 13. | K70Q | 27. | L89V | 41. | E115N | 55. | R189H |
| 14. | K70N | 28. | L89I | 42. | E115H | 56. | R189Q |

FIG. 12G

Interleukin-6

Protection against proteolysis

Sequence:

SSKEALAENNLNLPKMAEKDGCFQSGFNEETCLVKIITGLLEFEVYLEYLQNRFESSEE

QARAVQMSTKVLIQFLQKKAKNLDAITTPDPTTNASLLTKLQAQNQWLQDMTTHLILRS

FKEFLQSSLRALRQM

Exposed residues:

---------------PKMAEK---FQSGF----------T---E-----E--QNR-ES-E-

-----------------------DA-TTPDPTT-AS--TK-QAQNQW------------

---------R--RQM

Proteases:

['Trypsin', 'Endoproteinase Asp-N'; 'Chymotrypsin', 'Proline endopeptidase', 'Staphylococcal P.']

Exclusion list:['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | P64S | 16. | E92Q | 31. | D133N |
| 2. | P64A | 17. | E92N | 32. | P138S |
| 3. | K65Q | 18. | E92H | 33. | P138A |
| 4. | K65N | 19. | E98Q | 34. | D139Q |
| 5. | M66V | 20. | E98N | 35. | D139N |
| 6. | M66I | 21. | E98H | 36. | P140S |
| 7. | E68Q | 22. | R103H | 37. | P140A |
| 8. | E68N | 23. | R103Q | 38. | K149Q |
| 9. | E68H | 24. | E105Q | 39. | K149N |
| 10. | K69Q | 25. | E105N | 40. | W156S |
| 11. | K69N | 26. | E105H | 41. | W156H |
| 12. | F73I | 27. | E108Q | 42. | R178H |
| 13. | F73V | 28. | E108N | 43. | R178Q |
| 14. | F77I | 29. | E108H | 44. | R181H |
| 15. | F77V | 30. | D133Q | 45. | R181Q |

FIG. 12H

Leptin

Protection against proteolysis

Sequence:

VPIQKVQDDTKTLIKTIVTRINDISHTQSVSSKQKVTGLDFIPGLHPILTLSKMDQTLA

VYQQILTSMPSRNVIQISNDLENLRDLLHVLAFSKSCHLPWASGLETLDSLGGVLEASG

YSTEVVALSRLQGSLQDMLWQLDLSPGC

Exposed residues:

---------------------------------------P--H-IL----------

---------------------------------SCH-PW-SGLETLDS--GV-----

---------------------DLS-GC

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | |
|---|---|---|---|---|
| 1. | P43S | | 12. | E105N |
| 2. | P43A | | 13. | E105H |
| 3. | L49V | | 14. | L107V |
| 4. | L49I | | 15. | L107I |
| 5. | P99S | | 16. | D108Q |
| 6. | P99A | | 17. | D108N |
| 7. | W100S | | 18. | D141Q |
| 8. | W100H | | 19. | D141N |
| 9. | L104V | | 20. | L142V |
| 10. | L104I | | 21. | L142I |
| 11. | E105Q | | | |

FIG. 121

Leukemia inhibitory factor

Protection against proteolysis

Sequence:

PFPNNLDKLCGPNVTDFPPFHANGTEKAKLVELYRIVVYLGTSLGNITRDQKILNPSAL

SLHSKLNATADILRGLLSNVLCRLCSKYHVGHVDVTYGPDTSGKDVFQKKKLGCQLLGK

YKQIIAVLAQAF

Exposed residues:

------------------PFHAN-T---------R------T------R--KIL-PS-

LS-----------------------YH-GHVDVTYGPD-SGKDVF-----------

----------Q---

Proteases:

['Trypsin', 'Endoproteinase Asp-N', 'Chymotrypsin', 'Proline endopeptidase',

'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | P69S | 12. | L104I | 23. | P148S |
| 2. | P69A | 13. | P106S | 24. | P148A |
| 3. | F70I | 14. | P106A | 25. | D149Q |
| 4. | F70V | 15. | L109V | 26. | D149N |
| 5. | R85H | 16. | L109I | 27. | K153Q |
| 6. | R85Q | 17. | Y137H | 28. | K153N |
| 7. | R99H | 18. | Y137I | 29. | D154Q |
| 8. | R99Q | 19. | D143Q | 30. | D154N |
| 9. | K102Q | 20. | D143N | 31. | F156I |
| 10. | K102N | 21. | Y146H | 32. | F156V |
| 11. | L104V | 22. | Y146I | | |

FIG. 12J

Oncostatin M

Protection against proteolysis

Sequence:

ERPGAFPSEETLRGLGRRGFLQTLNATLGCVLHRLADLEQRLPKAQDLERSGLNIEDLE

KLQMARPNILGLRNNIYCMAQLLDNSDTAEPTKAGRGASQP

Exposed residues:

-------SEET-RGLG--------NA---C--HR-AD-EQR--KAQD-ERSGLNIE---

-------------------------------------------

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | E59Q | 12. | R84Q | 23. | D97N |
| 2. | E59N | 13. | D87Q | 24. | E99Q |
| 3. | E59H | 14. | D87N | 25. | E99N |
| 4. | E60Q | 15. | E89Q | 26. | E99H |
| 5. | E60N | 16. | E89N | 27. | R100H |
| 6. | E60H | 17. | E89H | 28. | R100Q |
| 7. | R63H | 18. | R91H | 29. | L103V |
| 8. | R63Q | 19. | R91Q | 30. | L103I |
| 9. | L65V | 20. | K94Q | 31. | E106Q |
| 10. | L65I | 21. | K94N | 32. | E106N |
| 11. | R84H | 22. | D97Q | 33. | E106H |

FIG. 12K

Erythropoietin

Protection against proteolysis

Sequence:

APPRLICDSRVLERYLLEAKEAENITTGCAEHCSLNENITVPDTKVNFYAWKRMEVGQQ

AVEVWQGLALLSEAVLRGQALLVNSSQPWEPLQLHVDKAVSGLRSLTTLLRALGAQKEA

ISPPDAASAAPLRTITADTFRKLFRVYSNFLRGKLKLYTGEACRTGDR

Exposed residues:

---------------------------------------N-T--DTKVNFYA-KR-EV---

--------A--SE--LR-QA--VNSSQ------------------------------

ISPPDA-SAAPLR-IT------------------------RTGDR

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | D43Q | 14. | E55N | 27. | L130V |
| 2. | D43N | 15. | E55H | 28. | L130I |
| 3. | K45Q | 16. | E72Q | 29. | R131H |
| 4. | K45N | 17. | E72N | 30. | R131Q |
| 5. | F48I | 18. | E72H | 31. | R162H |
| 6. | F48V | 19. | L75V | 32. | R162Q |
| 7. | Y49H | 20. | L75I | 33. | D165Q |
| 8. | Y49I | 21. | R76H | 34. | D165N |
| 9. | K52Q | 22. | R76Q | 35. | P121S |
| 10. | K52N | 23. | D123Q | 36. | P121A |
| 11. | R53H | 24. | D123N | 37. | P122S |
| 12. | R53Q | 25. | P129S | 38. | P122A |
| 13. | E55Q | 26. | P129A | | |

FIG. 12L

Flt3 ligand

Protection against proteolysis

Sequence:

TQDCSFQHSPISSDFAVKIRELSDYLLQDYPVTVASNLQDEELCGGLWRLVLAQRWMER

LKTVAGSKMQGLLERVNTEIHFVTKCAFQPPPSCLRFVQTN

Exposed residues:

TQD------------------------T--S--QD-EL-----------R--ER

-KTV-G--------------------A-QPPPSC-RFV---

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | |
|---|---|---|---|---|
| 1. | D3Q | | 15. | R59H |
| 2. | D3N | | 16. | R59Q |
| 3. | D40Q | | 17. | K61Q |
| 4. | D40N | | 18. | K61N |
| 5. | E42Q | | 19. | P89S |
| 6. | E42N | | 20. | P89A |
| 7. | E42H | | 21. | P90S |
| 8. | L43V | | 22. | P90A |
| 9. | L43I | | 23. | P91S |
| 10. | R55H | | 24. | P91A |
| 11. | R55Q | | 25. | R95H |
| 12. | E58Q | | 26. | R95Q |
| 13. | E58N | | 27. | F96I |
| 14. | E58H | | 28. | F96V |

FIG. 12M

Granulocyte-macrophage colony-stimulating factor

Protection against proteolysis

Sequence:

APARSPSPSTQPWEHVNAIQEARRLLNLSRDTAAEMNETVEVISEMFDLQEPTCLQTRL

ELYKQGLRGSLTKLKGPLTMMASHYKQHCPPTPETSCATQIITFESFKENLKDFLLVIP

FDCWEPVQE

Exposed residues:

---------------------------------------ET-E---SEM-DLQE--------

E--KQ--R----------------------PETSCATQI-T----------------

FD--EP---

Proteases:

['Trypsin', 'Endoproteinase Asp-N', 'Chymotrypsin', 'Proline endopeptidase',

'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | | | |
|---|---|---|---|---|---|---|---|
| 1. | E38Q | 14. | L49V | 27. | P92A | | |
| 2. | E38N | 15. | L49I | 28. | E93Q | | |
| 3. | E38H | 16. | E51Q | 29. | E93N | | |
| 4. | E41Q | 17. | E51N | 30. | E93H | | |
| 5. | E41N | 18. | E51H | 31. | F119I | | |
| 6. | E41H | 19. | E60Q | 32. | F119V | | |
| 7. | E45Q | 20. | E60N | 33. | D120Q | | |
| 8. | E45N | 21. | E60H | 34. | D120N | | |
| 9. | E45H | 22. | K63Q | 35. | E123Q | | |
| 10. | M46V | 23. | K63N | 36. | E123N | | |
| 11. | M46I | 24. | R67H | 37. | E123H | | |
| 12. | D48Q | 25. | R67Q | 38. | P124S | | |
| 13. | D48N | 26. | P92S | 39. | P124A | | |

FIG. 12N

Interleukin-13

Protection against proteolysis

Sequence:

GPVPPSTALRELIEELVNITQNQKAPLCNGSMVWSINLTAGMYCAALESLINVSGCSAI

EKTQRMLSGFCPHKVSAGQFSSLHVRDTKIEVAQFVKDLLLHLKKLFREGRFN

Exposed residues:

---------------------------------M-WS-NLTAG------E--INVSG----

----------------AGQFSSLHVRDTK------------------REGRFN

Proteases:

['Trypsin', 'Endoproteinase Asp-N', 'Chymotrypsin', 'Proline endopeptidase', 'Staphylococcal P.']

Exclusion list:['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | M32V | 11. | F79V | 21. | R107Q |
| 2. | M32I | 12. | L82V | 22. | E108Q |
| 3. | W34S | 13. | L82I | 23. | E108N |
| 4. | W34H | 14. | R85H | 24. | E108H |
| 5. | L38V | 15. | R85Q | 25. | R110H |
| 6. | L38I | 16. | D86Q | 26. | R110Q |
| 7. | E48Q | 17. | D86N | 27. | F111I |
| 8. | E48N | 18. | K88Q | 28. | F111V |
| 9. | E48H | 19. | K88N | | |
| 10. | F79I | 20. | R107H | | |

FIG. 120

Interleukin-2

Protection against proteolysis

Sequence:

APTSSSTKKTQLQLEHLLLDLQMILNGINNYKNPKLTRMLTFKFYMPKKATELKHLQCL
EEELKPLEEVLNLAQSKNFHLRPRDLISNINVIVLELKGSETTFMCEYADETATIVEFL
NRWITFCQSIISTLT

Exposed residues:

```
----------------------------------------K-Y--KKATEL---Q--
EE--KP-EE--NL-------------------------ETTFM-EYADET-T-----
-----------STLT
```

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | | | |
|---|---|---|---|---|---|---|---|
| 1. | K43Q | 13. | L53I | 25. | E68Q | 37. | E106Q |
| 2. | K43N | 14. | E60Q | 26. | E68N | 38. | E106N |
| 3. | Y45H | 15. | E60N | 27. | E68H | 39. | E106H |
| 4. | Y45I | 16. | E60H | 28. | L72V | 40. | Y107H |
| 5. | K48Q | 17. | E61Q | 29. | L72I | 41. | Y107I |
| 6. | K48N | 18. | E61N | 30. | E100Q | 42. | D109Q |
| 7. | K49Q | 19. | E61H | 31. | E100N | 43. | D109N |
| 8. | K49N | 20. | P65S | 32. | E100H | 44. | E110Q |
| 9. | E52Q | 21. | P65A | 33. | F103I | 45. | E110N |
| 10. | E52N | 22. | E67Q | 34. | F103V | 46. | E110H |
| 11. | E52H | 23. | E67N | 35. | M104V | 47. | L132V |
| 12. | L53V | 24. | E67H | 36. | M104I | 48. | L132I |

FIG. 12P

Interleukin-3

Protection against proteolysis

Sequence:

APMTQTTPLKTSWVNCSNMIDEIITHLKQPPLPLLDFNNLNGEDQDILMENNLRRPNLE

AFNRAVKSLQNASAIESILKNLLPCLPLATAAPTRHPIHIKDGDWNEFRRKLTFYLKTL

ENAQAQQTTLSLAIF

Exposed residues:

```
-----------------------------------F-N-NGE-QD-----------E
---R--KS-Q---------------------HP-H-KD-D--------------
---------------
```

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | |
|---|---|---|---|
| 1. | F37I | 12. | R63Q |
| 2. | F37V | 13. | K66Q |
| 3. | E43Q | 14. | K66N |
| 4. | E43N | 15. | P96S |
| 5. | E43H | 16. | P96A |
| 6. | D46Q | 17. | K100Q |
| 7. | D46N | 18. | K100N |
| 8. | E59Q | 19. | D101Q |
| 9. | E59N | 20. | D101N |
| 10. | E59H | 21. | D103Q |
| 11. | R63H | 22. | D103N |

FIG. 12Q

Interleukin-4

Protection against proteolysis

Sequence:

HKCDITLQEIIKTLNSLTEQKTLCTELTVTDIFAASKNTTEKETFCRAATVLRQFYSHH

EKDTRCLGATAQQFHRHKQLIRFLKRLDRNLWGLAGLNSCPVKEANQSTLENFLERLKT

IMREKYSKCSS

Exposed residues:

```
-------------------------E-T-----AASKNTT------------RQ--SH-
EK-TR-L-------------------------------SCPVKEANQ------------
-------KCSS
```

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | |
|---|---|---|---|
| 1. | E26Q | 14. | R64Q |
| 2. | E26N | 15. | L66V |
| 3. | E26H | 16. | L66I |
| 4. | K37Q | 17. | P100S |
| 5. | K37N | 18. | P100A |
| 6. | R53H | 19. | K102Q |
| 7. | R53Q | 20. | K102N |
| 8. | E60Q | 21. | E103Q |
| 9. | E60N | 22. | E103N |
| 10. | E60H | 23. | E103H |
| 11. | K61Q | 24. | K126Q |
| 12. | K61N | 25. | K126N |
| 13. | R64H | | |

FIG. 12R

Interleukin-5

Protection against proteolysis

Sequence:

IPTEIPTSALVKETLALLSTHRTLLIANETLRIPVPVHKNHQLCTEEIFQGIGTLESQT

VQGGTVERLFKNLSLIKKYIDGQKKKCGEERRRVNQFLDYLQEFLGVMNTEWIIES

Exposed residues:

----------------------------R-P--V-K------EE--Q--GT-ESQ-

-------------------------KK-GEER----------E-----NTEW----

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | R32H | 13. | E56Q | 25. | E89H |
| 2. | R32Q | 14. | E56N | 26. | R90H |
| 3. | P34S | 15. | E56H | 27. | R90Q |
| 4. | P34A | 16. | K84Q | 28. | E102Q |
| 5. | K39Q | 17. | K84N | 29. | E102N |
| 6. | K39N | 18. | K85Q | 30. | E102H |
| 7. | E46Q | 19. | K85N | 31. | E110Q |
| 8. | E46N | 20. | E88Q | 32. | E110N |
| 9. | E46H | 21. | E88N | 33. | E110H |
| 10. | E47Q | 22. | E88H | 34. | W111S |
| 11. | E47N | 23. | E89Q | 35. | W111H |
| 12. | E47H | 24. | E89N | | |

FIG. 12S

Stem cell factor

Protection against proteolysis

Sequence:

EGICRNRVTNNVKDVTKLVANLPKDYMITLKYVPGMDVLPSHCWISEMVVQLSDSLTDL

LDKFSNISEGLSNYSIIDKLVNIVDDLVECVKENSSKDLKKSFKSPEPRLFTPEEFFRI

FNRSIDAFKDFVVASETSDCVVS

Exposed residues:

------------------------M-T-K--P--DV----------V---D--TD-

-DKFSN----------------------SK-LKKSFKS-EPRL---------

------------ASETSDCVVS

Proteases:

['Trypsin', 'Endoproteinase Asp-N', 'Chymotrypsin', 'Proline endopeptidase', 'Staphylococcal P.']

Exclusion list:

['B', 'Z', 'X', '*', 'K', 'R', 'D', 'F', 'W', 'Y', 'M', 'L', 'P', 'E']

Substitutions:

| | | | | | |
|---|---|---|---|---|---|
| 1. | M27V | 16. | K62N | 31. | E106Q |
| 2. | M27I | 17. | F63I | 32. | E106N |
| 3. | K31Q | 18. | F63V | 33. | E106H |
| 4. | K31N | 19. | K96Q | 34. | P107S |
| 5. | P34S | 20. | K96N | 35. | P107A |
| 6. | P34A | 21. | L98V | 36. | R108H |
| 7. | D37Q | 22. | L98I | 37. | R108Q |
| 8. | D37N | 23. | K99Q | 38. | L109V |
| 9. | D54Q | 24. | K99N | 39. | L109I |
| 10. | D54N | 25. | K100Q | 40. | E134Q |
| 11. | D58Q | 26. | K100N | 41. | E134N |
| 12. | D58N | 27. | F102I | 42. | E134H |
| 13. | D61Q | 28. | F102V | 43. | D137Q |
| 14. | D61N | 29. | K103Q | 44. | D137N |
| 15. | K62Q | 30. | K103N | | |

FIG. 12T

RATIONAL EVOLUTION OF CYTOKINES FOR HIGHER STABILITY, THE CYTOKINES AND ENCODING NUCLEIC ACID MOLECULES

RELATED APPLICATIONS

This application is a divisional of U.S. application Ser. No. 10/658,834, entitled, "RATIONAL EVOLUTION OF CYTOKINES FOR HIGHER STABILITY, THE CYTOKINES AND ENCODING NUCLEIC ACID MOLECULES," filed Sep. 8, 2003, which claims the benefit of priority under 35 U.S.C. 119(e) to U.S. provisional application Ser. No. 60/457,135, entitled "RATIONAL EVOLUTION OF CYTOKINES FOR HIGHER STABILITY, ENCODING NUCLEIC ACID MOLECULES AND RELATED APPLICATIONS," filed Mar. 21, 2003, and U.S. provisional application Ser. No. 60/409,898, entitled "RATIONAL EVOLUTION OF CYTOKINES FOR HIGHER STABILITY, ENCODING NUCLEIC ACID MOLECULES AND RELATED APPLICATIONS," filed Sep. 9, 2002, each to Rene Gantier, Thierry Guyon, Manuel Vega and Lila Drittanti.

This application is related to U.S. application Ser. No. 11/176,830, filed Jul. 6, 2005, which is also a continuation of U.S. application Ser. No. 10/658,834, filed Sep. 8, 2003. This application is also related to PCT Application No. PCT/IB03/004347, entitled, "RATIONAL EVOLUTION OF CYTOKINES FOR HIGHER STABILITY, THE CYTOKINES AND ENCODING NUCLEIC ACID MOLECULES," to Rene Gantier, Thierry Guyon, Manuel Vega and Lila Drittanti. This application also is related to U.S. application Ser. No. 10/658,355, filed Sep. 08, 2003, entitled "RATIONAL DIRECTED PROTEIN EVOLUTION USING TWO-DIMENSIONAL RATIONAL MUTAGENESIS SCANNING," and to U.S. provisional application Ser. No. 60/457,063, entitled "RATIONAL DIRECTED PROTEIN EVOLUTION USING TWO-DIMENSIONAL RATIONAL MUTAGENESIS SCANNING," filed Mar. 21, 2003, and to U.S. provisional application Ser. No. 60/410,258, entitled "RATIONAL DIRECTED PROTEIN EVOLUTION USING TWO-DIMENSIONAL RATIONAL MUTAGENESIS SCANNING," filed Sep. 9, 2002, each to Rene Gantier, Thierry Guyon, Hugo Cruz Ramos, Manuel Vega and Lila Drittanti. This application also is related to co-pending U.S. application Ser. No. 10/022,249, filed Dec. 17, 2001, entitled "HIGH THROUGHPUT DIRECTED EVOLUTION BY RATIONAL MUTAGENESIS," to Manuel Vega and Lila Drittanti.

The subject matter of each of the above-noted applications, international applications and provisional applications is incorporated by reference in its entirety.

Incorporation by Reference of Sequence Listing Provided on Compact Discs

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Feb. 1, 2007 is identical, 1,843 kilobytes in size, and titled 922GSEQ.001.txt. A substitute Sequence Listing, incorporated by reference in its entirety, is provided on identical compact discs (labeled Copy 1 Replacement, Copy 2 Replacement, and Computer-readable form Replacement), each compact disc containing the file 922GSEQ.002.txt, created on May 2, 2007, and 1,843 kilobytes in size.

FIELD OF INVENTION

Modified cytokine proteins having selected modified properties compared to the unmodified or wild type proteins, and nucleic acid molecules encoding these proteins are provided. The proteins can be used for treatment and diagnosis.

BACKGROUND

The delivery of therapeutic proteins for clinical use is a major challenge to pharmaceutical science. Once in the blood stream, these proteins are constantly eliminated from circulation within a short time by different physiological processes, involving metabolism as well as clearance using normal pathways for protein elimination, such as (glomerular) filtration in the kidneys or proteolysis in blood. The latter is often the limiting process affecting the half-life of proteins used as therapeutic agents in per-oral administration and either intravenous or intramuscular injection. The problems associated with these routes of administration of proteins are well known and various strategies have been used in attempts to solve them.

A protein family, which has been the focus of much clinical work, and efforts to improve its administration and bio-assimilation, is the cytokine family, including the interferon family. Interferon molecules are grouped in the heterogeneous family of cytokines, originally identified on the basis of their ability to induce cellular resistance to viral infections (Diaz et al., *J. Interferon Cytokine Res.*, 16:179-180, 1996). Type I interferons, referred to as interferons α/β, include many members of the interferon α family (interferon α1, α2, ω and τ) as well as interferon β. The type II interferon γ is different from type I in its particular mechanisms that regulate its production. Whereas the production of interferons α/β is most efficiently induced in many types of cells upon viral infection, interferon-γ is produced mainly in cells of hemopoietic system, such as T-cells or natural killer cells, upon stimulation by antigens or cytokines, respectively. These two interferon systems are functionally non-redundant in the antiviral defense host.

Interferon α, hereinafter "interferon alpha-2b," or "interferon α-2b" or "IFNα-2b," used interchangeably, has a broad spectrum of biological effects, including antiviral effects. Antiviral effects include antiproliferative and immunomodulatory actions (Stark et al., *Annu. Rev. Biochem.*, 67: 227-264, 1998). As well as eliciting strong antiviral activities in target cells, interferons α/β also activate effector cells of the innate immune system such as natural killer cells and macrophages (Pestka et al., *Annu. Rev. Biochem.*, 56: 727-777, 1987; Biron et al., Annu. Rev. Immunol., 17:189-220, 1999). As part of its immuno-modulatory action, interferon type I protects T-lymphocytes from apoptosis (Scheel-Toeller et al., *Eur. J Immunol.*, 29:2603-2612, 1999; Marrack et al., *J. Exp. Med.*, 189:521-530, 1999) and growth enhancing factors (Robert et al., *Hematol. Oncol.*, 4:113-120, 1986; Morikawa et al., *J. Immunol.*, 139:761-766, 1987). The biological effects of interferons α/β are initiated upon binding to the IFN type I receptor, which results in activation of several downstream effector molecules (Hibbert and Foster, *J. Interferon Cytokine Res.*, 19:309-318, 1999).

Interferons as well as many cytokines are important therapeutics. Since naturally occurring variants have not evolved as therapeutics, they often have undesirable side-effects as well as the above-noted problems of short-half life, administration and bioavailability. Hence, there is a need to improve properties of cytokines, including interferons, for use as therapeutic agents. Therefore, among the objects herein, it is an object to provide cytokines that have improved therapeutic properties.

SUMMARY

Provided herein are methods for directed evolution of families of proteins and resulting families of modified proteins. A family, such as the cytokine protein family, is initially identified. A property or phenotype for modification, such as resistance to proteolysis for increased stability in blood, is selected for modification. A representative member or members of the family, such as members of the interferon α family, such as IFNα-2b or IFNα-2a, or interferon β family, is (are) selected. It is modified using any directed evolution method and protein(s) with a desired phenotype are screened and identified. In addition, the 3-dimensional structure of the protein can be mapped to topologically and spatially identify the loci that are modified to achieve the phenotypic change. 3-dimensional structures of other members of the family are generated or obtained and compared with the modified family member. Loci in the other family members that correspond on the protein to those modified in the original protein are identified and modified. The resulting proteins can be tested to confirm that they exhibit the modified phenotype.

Provided herein are methods for generating modified cytokines based on structural homology (3D scanning). These methods are based on the spatial and topological structure; they are not based on their underlying sequences of amino acid residues. The methods are used for identification of target sites for mutagenesis, particularly in families of target proteins. The targets are identified through comparison of patterns of protein backbone folding between and among structurally related proteins. The methods are exemplified herein for cytokines. Families of the modified cytokines also are provided herein.

Any protein known or otherwise available to those of skill in the art is suitable for modification, such as optimization or improvement of a selected property, using the directed evolution methods provided herein, including cytokines (e.g., IFNα, including IFNα-2b and IFNα-2a, and IFNβ) or any other proteins that have already been mutated or optimized.

Provided herein are modified cytokines that exhibit increased resistance to proteolysis as assessed in vivo or in vitro. Typically the increase in resistance is a least 5%, generally 8%, 10% or more. The modified cytokines provided herein include those designed by 3D scanning using the interferon α's that were modified based upon 2D scanning methods herein.

Also provided herein are modified (mutant) cytokine proteins, such as variants of IFNβ and IFNα, including IFNα-2b and IFNα-2a proteins and IFNβ proteins, that have altered, particularly, improved therapeutic properties, including higher stability compared to the unmodified forms. In particular, exemplary modified cytokines provided herein have increased stability, which, for example, improves their use as therapeutics. Among the modified cytokines provided herein are those that exhibit increased resistance to proteolysis compared to the unmodified cytokine. In particular, such resistance is at least 10%, 20%, 30%, 40%, 50%, 70%, 100% or more resistant to proteolysis compared to the unmodified cytokine. Also provided are cytokines that have increased anti-proliferative and/or antiviral activity and/or resistance to proteolysis compared to an unmodified cytokine.

Exemplary of the modified cytokines provided herein are modified interferons that exhibit higher stability compared to unmodified forms. Such modified interferons can be used for treating conditions in humans that are responsive to treatment with interferons, such, but are not limited to, as viral infections, cancer or tumors, undesired cell proliferation and for immuno-modulation.

Exemplary of proteins that can be modified by the 2D and 3D scanning methods provided herein are cytokines from the interferons/interleukin-10 family. This family includes, for example, interleukin-10 (IL-10; SEQ ID NO:200, interferon beta (IFNβ; SEQ ID NO: 196), interferon alpha-2a (IFNα-2a; SEQ ID NO: 182), interferon alpha-2b (IFNα-2b; SEQ ID NO:1), and interferon gamma (IFN-γ; SEQ ID NO: 199). The long-chain cytokine protein family includes, among others, granulocyte colony stimulating factor (G-CSF; SEQ ID NO: 210), leukemia inhibitory factor (LIF; SEQ ID NO: 213), growth hormone (hGH; SEQ ID NO: 216), ciliary neurotrophic factor (CNTF; SEQ ID NO: 212), leptin (SEQ ID NO: 211), oncostatin M (SEQ ID NO: 214), interleukin-6 (IL-6; SEQ ID NO: 217) and interleukin-12 (IL-12; SEQ ID NO: 215). The short-chain cytokine protein family includes, among others, erythropoietin (EPO; SEQ ID NO: 201), granulocyte-macrophage colony stimulating factor (GM-CSF; SEQ ID NO: 202), interleukin-2 (IL-2; SEQ ID NO: 204), interleukin-3 (IL-3; SEQ ID NO: 205), interleukin-4 (IL-4; SEQ ID NO: 207), interleukin-5 (IL-5; SEQ ID NO: 208), interleukin-13 (IL-13; SEQ ID NO: 209), Flt3 ligand (SEQ ID NO: 203) and stem cell factor (SCF; SEQ ID NO: 206). Modified forms of each that have increased resistance to proteolysis are provided. They were generated by comparison among the 3D-structures to identify residues that improve resistance to proteolysis.

Pharmaceutical compositions containing each modified cytokine and uses and methods of treatment are provided.

The modified cytokines have use as therapeutics. Each cytokine has improved biological and or therapeutic activity, compared to the know activity of the unmodified cytokine. Accordingly, uses of the cytokines for treatment of cytokine-mediated diseases and diseases for which immunotherapy is employed are provided. Methods of treatment using the modified cytokines for diseases also are provided. Each cytokine has a known therapeutic use, and such use is contemplated herein. Cytokines provided herein have improved properties, such as increased bioavailability, improved stability, particularly in vivo, and/or greater efficacy.

BRIEF DESCRIPTION OF THE FIGURES

FIG. 1(A) displays the sequence of the mature IFNα-2b (SEQ ID NO: 1). Residues targeted by a mixture of proteases, including a-chymotrypsin (F, L, M, W, and Y), endoproteinase Arg-C (R), endoproteinase Asp-N (D), endoproteinase Glu-C (E), endoproteinase Lys-C (K), and trypsin (K, and R), are underlined and in bold lettering.

FIG. 1(B) displays the structure of IFNα-2b obtained from the NMR structure of IFNα-2a (PDB code 1ITF) in ribbon representation. Surface residues exposed to the action of the proteases considered in FIG. 1A are in space filling representation.

FIG. 2 depicts the "Percent Accepted Mutation" (PAM250) matrix Values given to identical residues are shown in gray squares. Highest values in the matrix are shown in black squares and correspond to the highest occurrence of substitution between two residues.

FIG. 3 presents the scores obtained from PAM250 analysis for the amino acid substitutions (replacing amino acids on the vertical axis; amino acid position on the horizontal axis) aimed at introducing resistance to proteolysis into the IFNα-2b at the protease target sequences. The two best replacing residues for each target amino acid according to the highest substitution scores are shown in black rectangles.

Figure 4A:
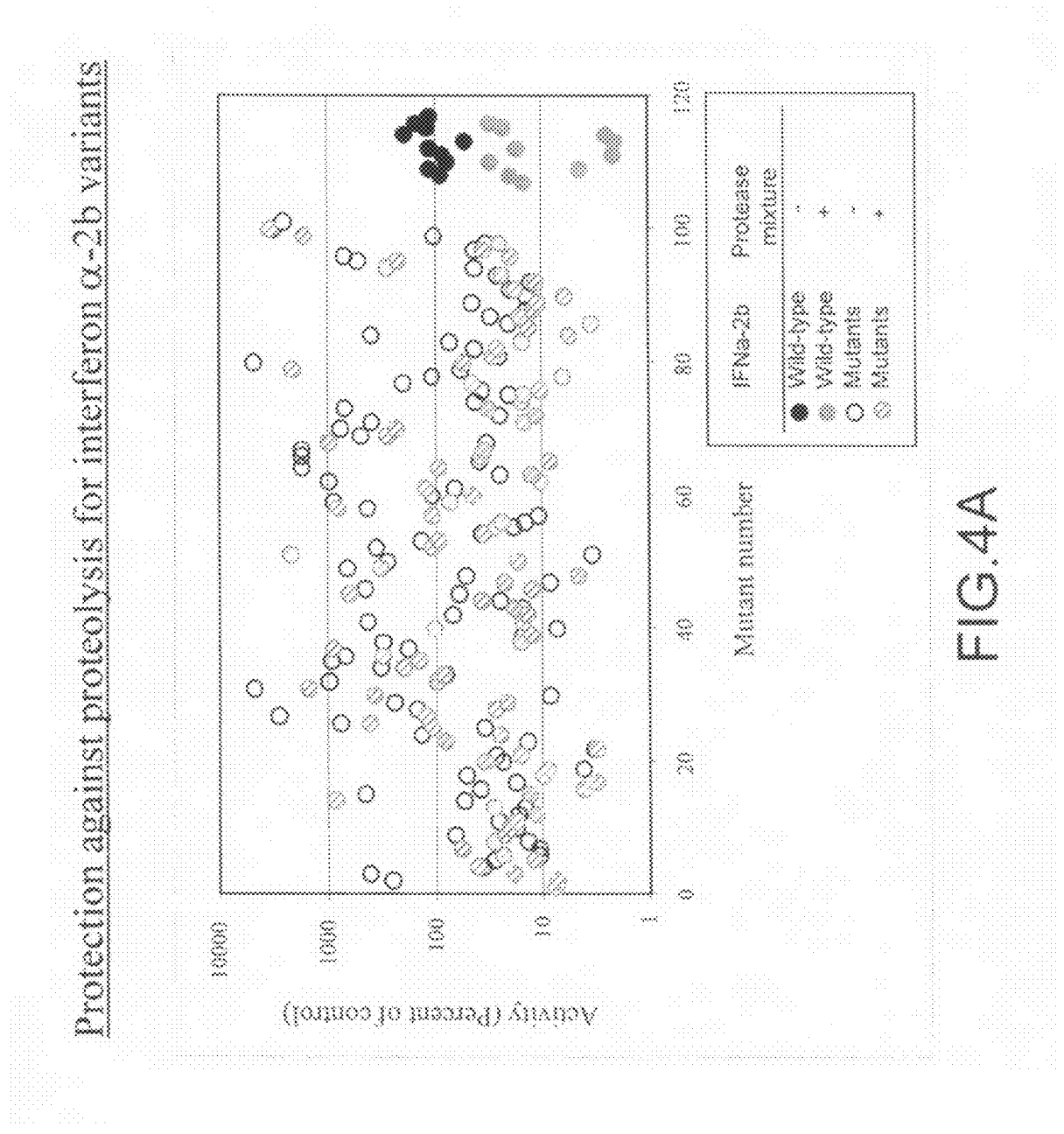

FIGS. 4(A)-4(C) provide graphs of experiments indicating the levels of protection against in vitro proteolysis for IFNα-2b variants produced in mammalian cells. In FIGS. 4(B) and 4(C), the vertical axis indicates the relative level of non-proteolyzed protein and the horizontal axis indicates time in hours.

FIG. 5 displays the characterization of several IFNα-2b variants, produced in mammalian cells, treated with α-chymotrypsin.

FIG. 6(A) shows the characterization of the E113H IFNα-2b variant when treated with α-chymotrypsin. The percent of residual (anti-viral) activity for the variant (black line and white circles) after treatment with α-chymotrypsin was compared to the treated wild-type IFNα-2b (dashed line and black squares). For this experiment, the E113H IFNα-2b variant was produced in mammalian cells.

FIG. 6(B) shows the characterization of the E113H IFNα-2b variant treated with a mixture of proteases. The percent of residual (anti-viral) activity for the variant (black line and white circles) after treatment with protease mixture was compared to the treated wild-type IFNα-2b (dashed line and black squares). For this experiment, the E113H IFNα-2b variant was produced in mammalian cells.

FIG. 6(C) presents the characterization of the E113H IFNα-2b variant treated with blood lysate. The percent of residual (anti-viral) activity for the variant (black line and white circles) after treatment with blood lysate was compared to the treated wild-type IFNα-2b (dashed line and black squares). For this experiment, the E113H IFNα-2b variant was produced in mammalian cells.

FIG. 6(D) presents the characterization of the E113H IFNα-2b variant treated with serum. The percent of residual (anti-viral) activity for the variant (black line and white circles) after treatment with serum was compared to the treated wild-type IFNα-2b (dashed line and black squares). For this experiment, the E113H IFNα-2b variant was produced in mammalian cells.

FIGS. 6(E) and 6(F) provide graphs indicating the levels of protection against in vitro proteolysis for IFNα-2b variants produced in bacteria. In FIGS. 6(E) and 6(F), the vertical axis indicates the relative level of non-proteolyzed protein and the horizontal axis indicates time in hours. The percent of residual (anti-viral) activity for the variants (gray circles with continuous lines) after treatment were compared to the treated wild-type IFNα-2b (solid circles with dashed lines).

FIG. 6(G) provides graphs indicating the in vitro potency for antiviral activity, for IFNα-2b variants produced in bacteria. The vertical axis indicates the level of antiviral activity and the horizontal axis indicates concentration of the variants at which each level of activity is achieved. The activity for the variants (continuous line with gray circles) was compared to that of the wild-type IFNα-2b (black triangles with dashed lines). The potency for each variant was calculated from the graphs as the concentration at the inflection point of the respective curves. FIG. 6(T) shows the value of potency obtained for each variant tested compared to the wild type IFNα.

FIG. 6(H) provides the in vitro potency for anti-proliferation activity, for IFNα-2b variants produced in bacteria. The activity for the variants was compared to that of the wild-type IFNα-2b in serial dilution experiments where the anti-proliferation activity was measured for a number of dilutions for each variant. Potency was calculated from the graphs as the concentration at the inflection point of the respective curves. The figure shows the value of potency obtained for each variant tested and in comparison to the wild type IFNα.

FIGS. 6(I) to 6(N) provide graphs indicating the pharmacokinetics in mice following subcutaneous injection of IFNα-2b variants produced in bacteria. The vertical axis indicates the level of antiviral activity in blood and the horizontal axis indicates the time after injection at which the level of antiviral activity is determined. The pharmacokinetics of the variants (in gray solid circles with gray continuous lines) was compared to that of the wild-type IFNα-2b (in black with dashed lines) and of a pegylated derivative (Pegasys, Roche) (36 µg/ml open triangles with continuous black lines; and 18 µg/ml open circles with continuous black lines); and vehicle (gray solid triangles with continuous gray lines. The Area Under the Curve (AUC) for each variant was calculated from the graphs and is shown in 6(U).

FIG. 6(O) provides graphs indicating the levels of protection against in vitro proteolysis for IFNβ variants produced in mammalian cells. FIG. 6(N), the vertical axis indicates the relative level of non-proteolyzed protein and the horizontal axis indicates time in hours. The percent of residual (anti-viral) activity for the variants after treatment were compared to the treated wild-type IFNβ.

FIGS. 6(P) to 6(S) provide graphs indicating the in vitro potency for either antiviral activity (6(P) and 6(Q)) or anti-proliferative activity (6(R) and 6(S), for a number of IFNβ variants produced in mammalian cells. The vertical axis indicates the level of (antiviral or anti-proliferation) activity and the horizontal axis indicates the concentration of the variants at which each level of activity is achieved. The activity for the variants (6(Q) and (6(S)) was compared to that of the wild-type IFNβ (6(P) and (6(R)). The activity obtained with either no previous treatment or by treating the variants with proteases prior to the activity test is shown.

FIG. 6(T) provides a comparison of antiviral activity (potency), anti-proliferation activity (potency), number of mutations present and AUC (from PK) for a number of IFNα-2b and in comparison with the wild-type IFNα-2b.

FIG. 6(U) provides IFN units injected and protein injected (µg/ml) for the data in FIG. 6(T).

FIG. 7(A) depicts a top view ribbon representation of IFNα-2b structure obtained from the NMR structure of IFNα-2a (PDB code 1ITF). Residues represented in "space filling" define (1) the "receptor binding region" based on either our "alanine scanning" analysis or on studies by Piehler et al., *J. Biol. Chem.*, 275:40425-40433, 2000, and Roisman et al., *Proc. Natl. Acad. Sci. USA*, 98:13231-13236, 2001 (in light-gray and dark-gray, respectively), and (2) replacing residues (LEADs) for resistance to proteolysis (in black).

FIG. 7(B) depicts a side view ribbon representation of IFNα-2b structure. Residue representation is as in FIG. 7A.

FIG. 8(A) schematizes the identification of homologous amino acid positions between a number of cytokines and the LEAD mutants of IFNα-2b using 3-dimensional scanning (also referred to herein as based on "structure-based homology" methods or "structural homology" methods).

FIG. 9 illustrates a structural alignment of a number of cytokines and interferon α-2b sequences (SEQ ID NO: 1 (IFN-α2b); SEQ ID NO: 196 (IFN-β); SEQ ID NO: 201 (EPO); and SEQ ID NO: 210 (G-CSF)). Bold underlined residues define the region on each cytokine sequence that based on structural homology comparison corresponds to the structurally-related mutations found on the LEADs for protease resistance of IFNα-2b.

Figure 10A:
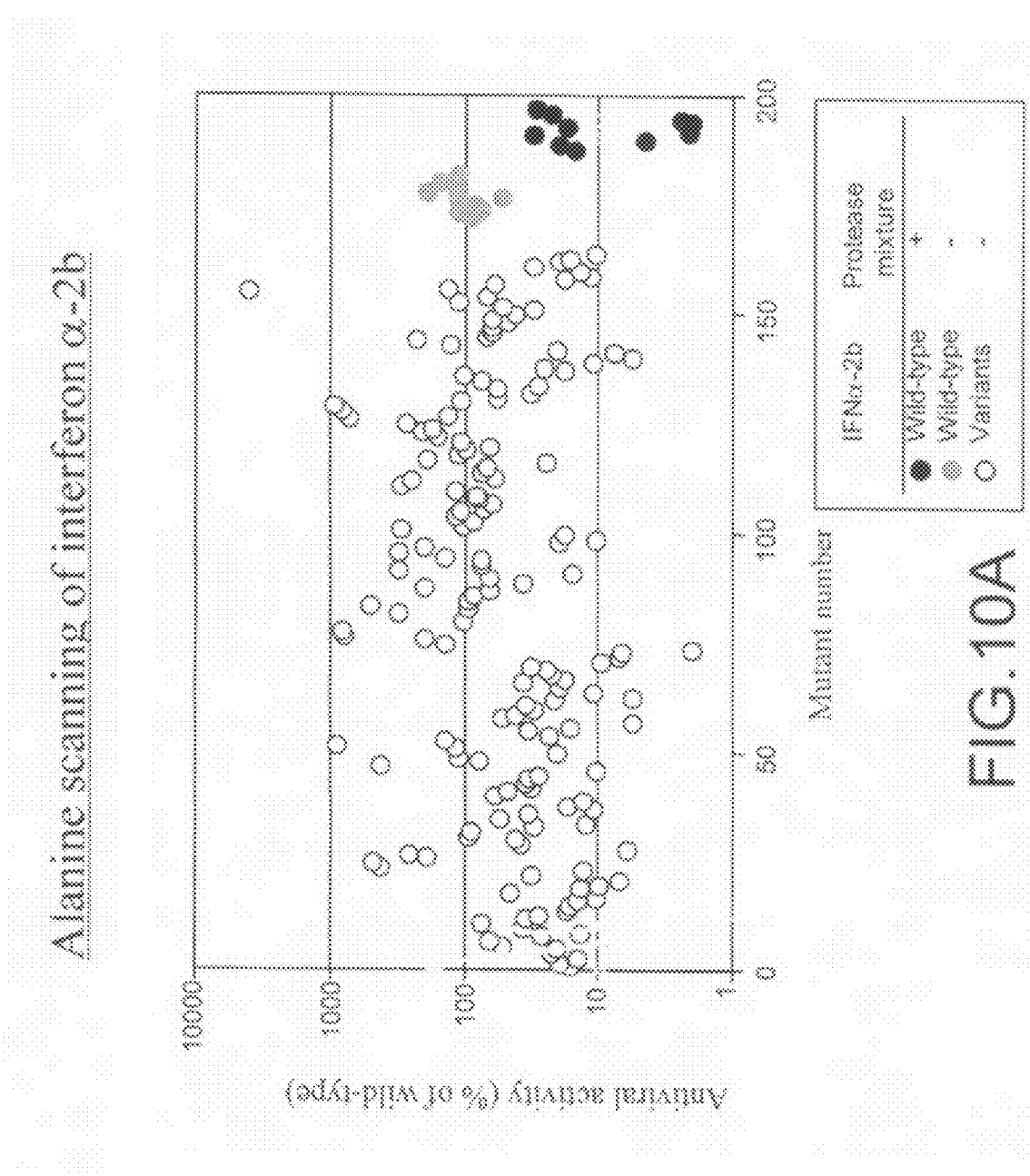

FIG. 10(A) shows the antiviral activity of interferon α-2b mutants generated by alanine-scanning analysis used for protein redesign. Plotted symbols for wild type and variants of interferon α-2b are indicated in the inset.

Figure 10B:
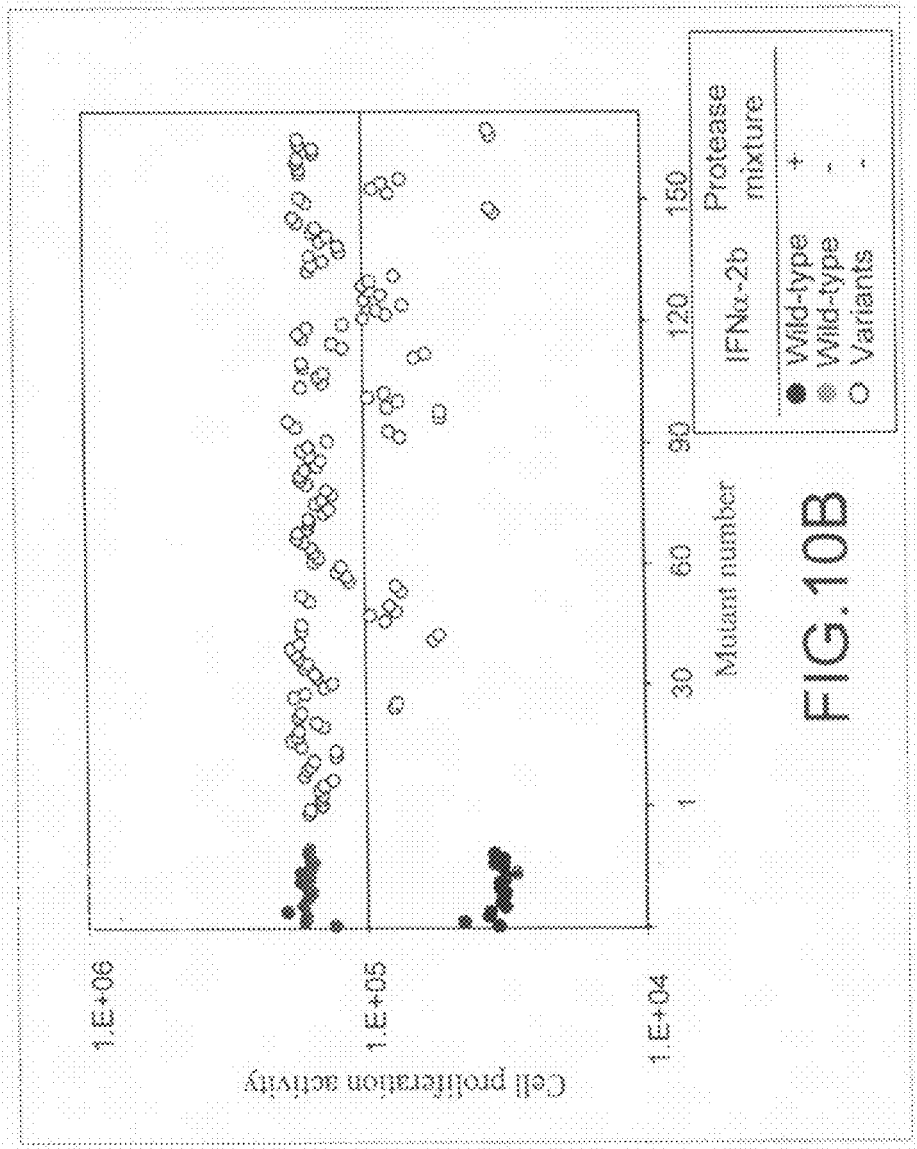

FIG. 10(B) displays cell proliferation after treatment with interferon α-2b mutants obtained by alanine-scanning analysis. Plotted symbols for wild type and variants of interferon α-2b are indicated in the inset.

Figure 10C:
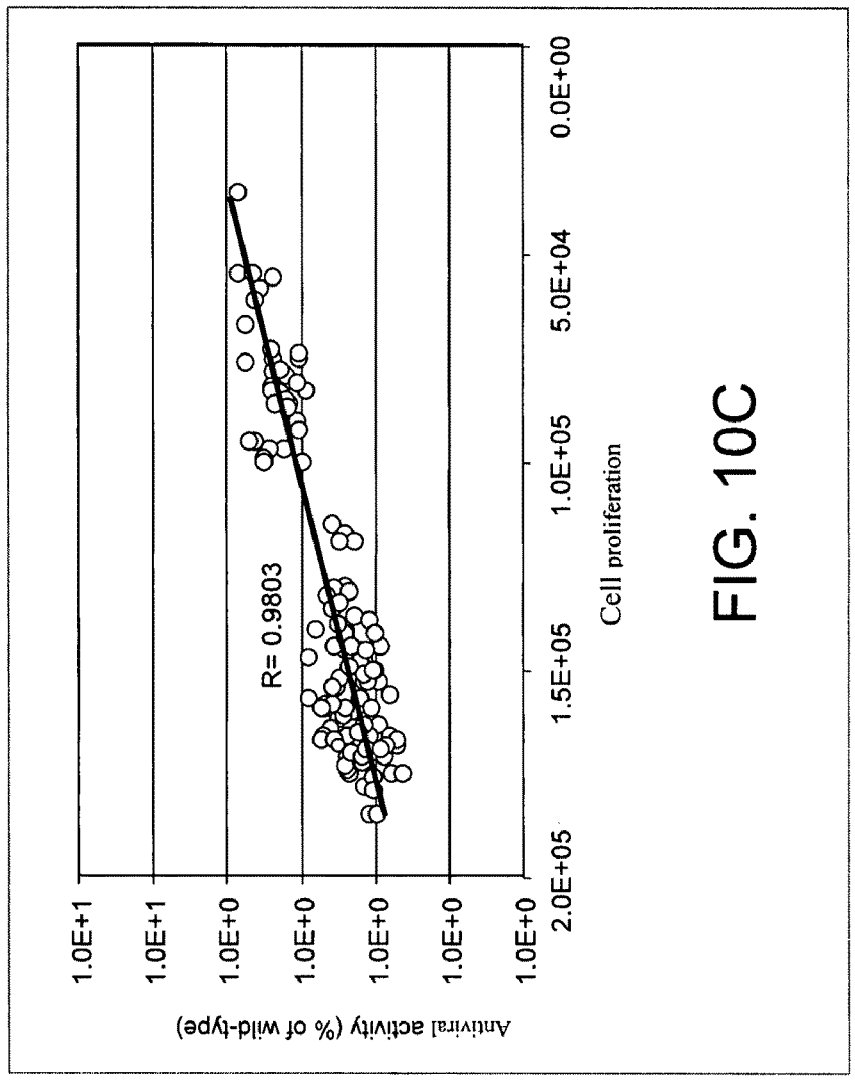

FIG. 10(C) displays the correlation between the antiviral activity and cell proliferation activity of interferon α-2b mutants obtained by alanine-scanning analysis.

FIG. 11 Candidate glycosylation sites for interferon α-2b stabilization and redesign thereof.

FIG. 12(A) shows a representative number of the is-HIT residue positions and type of replacing amino acids selected to generate modified protein sequences of interferon β (corresponding to SEQ ID Nos: 233-289, 989-1015, and 1016-1302) compared to the wild-type sequence (SEQ ID NO: 196), based on 3D-scanning (structural homology method), including PAM250 analysis.

FIG. 12(B) displays the is-HIT residue positions and type of replacing amino acids selected to generate modified protein sequences of interferon gamma (corresponding to SEQ ID Nos: 290-311) compared to residues 1-100 of the wild-type sequence (SEQ ID NO: 199), based on structural homology and PAM250 analysis.

FIG. 12(C) shows the is-HIT residue positions and type of replacing amino acids selected to generate modified protein sequences of interleukin-10 (corresponding to SEQ ID Nos: 312-361) compared to residues 1-100 of the wild-type sequence (SEQ ID NO: 200), based on structural homology and PAM250 analysis.

FIG. 12(D) displays the is-HIT residue positions and type of replacing amino acids selected to generate modified protein sequences of ciliary neurotrophic factor (corresponding to SEQ ID Nos: 684-728) compared to residues 51-188 of the wild-type sequence (SEQ ID NO: 212), based on structural homology and PAM250 analysis.

FIG. 12(E) shows the is-HIT residue positions and type of replacing amino acids selected to generate modified protein sequences of granulocyte-colony stimulating factor (corresponding to SEQ ID Nos: 631-662) compared to residues 51-177 of the wild-type sequence (SEQ ID NO: 210), based on structural homology and PAM250 analysis.

FIG. 12(F) displays the is-HIT residue positions and type of replacing amino acids selected to generate modified protein sequences of human growth hormone (corresponding to SEQ ID Nos: 850-895) compared to residues 51-191 of the wild-type sequence (SEQ ID NO: 216), based on structural homology and PAM250 analysis.

FIG. 12(G) shows the is-HIT residue positions and type of replacing amino acids selected to generate modified protein sequences of interleukin-12 (corresponding to SEQ ID Nos: 794-849) compared to residues 51-197 of the wild-type sequence (SEQ ID NO: 215), based on structural homology and PAM250 analysis.

FIG. 12(H) displays the is-HIT residue positions and type of replacing amino acids selected to generate modified protein sequences of interleukin-6 (corresponding to SEQ ID Nos: 896-939) compared to residues 51-183 of the wild-type sequence (SEQ ID NO: 217), based on structural homology and PAM250 analysis.

FIG. 12(I) shows the is-HIT residue positions and type of replacing amino acids selected to generate modified protein sequences of leptin (corresponding to SEQ ID Nos: 663-683) compared to the wild-type sequence (SEQ ID NO: 211), based on structural homology and PAM250 analysis.

FIG. 12(J) displays the is-HIT residue positions and type of replacing amino acids selected to generate modified protein sequences of leukemia inhibitory factor (corresponding to SEQ ID Nos: 729-760) compared to residues 51-180 of the wild-type sequence (SEQ ID NO: 213), based on structural homology and PAM250 analysis.

FIG. 12(K) shows the is-HIT residue positions and type of replacing amino acids selected to generate modified protein sequences of oncostatin M (corresponding to SEQ ID Nos: 761-793) compared to residues 51-150 of the wild-type sequence (SEQ ID NO: 214), based on structural homology and PAM250 analysis.

FIG. 12(L) displays the is-HIT residue positions and type of replacing amino acids selected to generate modified protein sequences of erythropoietin (corresponding to SEQ ID Nos: 940-977) compared to the wild-type sequence (SEQ ID NO: 201), based on structural homology and PAM250 analysis.

FIG. 12(M) shows the is-HIT residue positions and type of replacing amino acids selected to generate modified protein sequences of Flt3 ligand (corresponding to SEQ ID Nos: 401-428) compared to residues 1-100 of the wild-type sequence (SEQ ID NO: 203), based on structural homology and PAM250 analysis.

FIG. 12(N) displays the is-HIT residue positions and type of replacing amino acids selected to generate modified protein sequences of granulocyte-macrophage colony-stimulating factor (corresponding to SEQ ID Nos: 362-400) compared to the wild-type sequence (SEQ ID NO: 202), based on structural homology and PAM250 analysis.

FIG. 12(O) shows the is-HIT residue positions and type of replacing amino acids selected to generate modified protein sequences of interleukin-13 (corresponding to SEQ ID Nos: 603-630) compared to the wild-type sequence (SEQ ID NO: 209), based on structural homology and PAM250 analysis.

FIG. 12(P) displays the is-HIT residue positions and type of replacing amino acids selected to generate modified protein sequences of interleukin-2 (corresponding to SEQ ID Nos: 429-476) compared to the wild-type sequence (SEQ ID NO: 204), based on structural homology and PAM250 analysis.

FIG. 12(Q) shows the is-HIT residue positions and type of replacing amino acids selected to generate modified protein sequences of interleukin-3 (corresponding to SEQ ID Nos: 477-498) compared to the wild-type sequence (SEQ ID NO: 205), based on structural homology and PAM250 analysis.

FIG. 12(R) displays the is-HIT residue positions and type of replacing amino acids selected to generate modified protein sequences of interleukin-4 (corresponding to SEQ ID Nos: 543-567) compared to the wild-type sequence (SEQ ID NO: 207), based on structural homology and PAM250 analysis.

FIG. 12(S) shows the is-HIT residue positions and type of replacing amino acids selected to generate modified protein sequences of interleukin-5 (corresponding to SEQ ID Nos: 568-602) compared to the wild-type sequence (SEQ ID NO: 208), based on structural homology and PAM250 analysis.

FIG. 12(T) displays the is-HIT residue positions and type of replacing amino acids selected to generate modified protein sequences of stem cell factor (corresponding to SEQ ID Nos: 499-542) compared to residues 1-141 of the wild-type sequence (SEQ ID NO: 206), based on structural homology and PAM250 analysis.

DETAILED DESCRIPTION

A. Definitions
B. Directed Evolution
1. Pure Random Mutagenesis
2. Restricted Random Mutagenesis
3. Non-Restricted Rational Mutagenesis
C. 2-Dimensional Rational Scanning (2D Scanning)
1. Identifying In-silico HITS
2. Identifying Replacing Amino Acids
a. Percent Accepted Mutation (PAM)
i. PAM Analysis
ii. PAM250
b. Jones et al. and Gonnet et al.
c. Fitch and Feng et al.
d. McLachlan, Grantham and Miyata
e. Rao
f. Risler et al.
g. Johnson et al.
h. Block Substitution Matrix (BLOSUM)
3. Physical Construction of Mutant Proteins and Biological Assays
D. 2-Dimensional Scanning of Proteins for Increased Resistance to Proteolysis
E. Rational Evolution of IFNα-2b For Increased Resistance to Proteolysis
1. Modified IFNα-2b Proteins with Single Amino Acid Substitutions (is-HITs)
2. LEAD identification
3. N-glycosylation Site Addition
F. Protein Redesign
G. 3D-scanning and Its Use for Modifying Cytokines
1. Homology
2. 3D-Scanning (Structural Homology) Methods
3. Application of the 3D-Scanning Method to Cytokines
a. Structurally Homologous Interferon Mutants
b. Structurally Homologous Cytokine Mutants
H. Rational Evolution of IFNβ For Increased Resistance to Proteolysis and/or Higher Conformational Stability
I. Super-LEADs and Additive Directional Mutagenesis (ADM).
1. Additive Directional Mutagenesis
2. Multi-Overlapped Primer Extensions
J. Uses of the Mutant IFNα and IFNβ Genes and Cytokines in Therapeutic Methods
1. Fusion Proteins
2. Nucleic Acid Molecules for Expression
3. Formulation of Optimized Cytokines and Methods of Treatment
K. Examples

A. Definitions

Unless defined otherwise, all technical and scientific terms used herein have the same meaning as is commonly understood by one of skill in the art to which the invention(s) belong. All patents, patent applications, published applications and publications, Genbank sequences, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, biological activity of a protein refers to any activity manifested by the protein in vivo.

As used herein, "a directed evolution method" refers to methods that "adapt" either natural proteins, synthetic proteins or protein domains to work in new or existing natural or artificial chemical or biological environments and/or to elicit new functions and/or to increase or decrease a given activity, and/or to modulate a given feature. Exemplary directed evolution methods include pure random mutagenesis methods; restricted random mutagenesis methods; and non-restricted rational mutagenesis methods, such as the rational directed evolution method described in co-pending U.S. application Ser. No. 10/022,249; and the 2-dimensional rational scanning method provided herein.

As used herein, two dimensional rational mutagenesis scanning (2D scanning) refers to the processes provided herein in which two dimensions of a particular protein sequence are scanned: (1) one dimension is to identify specific amino acid residues along the protein sequence to replace with different amino acids, referred to as is-HIT target positions, and (2) the second dimension is the amino acid type selected for replacing the particular is-HIT target, referred to as the replacing amino acid.

As used herein, in silico refers to research and experiments performed using a computer. In silico methods include, but are not limited to, molecular modeling studies, and biomolecular docking experiments.

As used herein, "is-HIT" refers to an in silico identified amino acid position along a target protein sequence that has been identified based on i) the particular protein properties to be evolved, ii) the protein's amino acid sequence, and/or iii) the known properties of the individual amino acids. These is-HIT loci on the protein sequence are identified without use of experimental biological methods. For example, once the protein feature(s) to be optimized is (are) selected, diverse sources of information or previous knowledge (i.e., protein primary, secondary or tertiary structures, literature, patents) are exploited to determine those amino acid positions that may be amenable to improved protein fitness by replacement with a different amino acid. This step utilizes protein analysis "in silico." All possible candidate amino acid positions along a target protein's primary sequence that might be involved in the feature being evolved are referred to herein as "in silico HITs" ("is-HITs"). The collection (library), of all is-HITs identified during this step represents the first dimension (target residue position) of the two-dimensional scanning methods provided herein.

As used herein, "amenable to providing the evolved predetermined property or activity," in the context of identifying is-HITs, refers to an amino acid position on a protein that is contemplated, based on in silico analysis, to possess properties or features that when replaced would result in the desired activity being evolved. The phrase "amenable to providing the evolved predetermined property or activity," in the context of identifying replacement amino acids, refers to a particular amino acid type that is contemplated, based on in silico analysis, to possess properties or features that when used to replace the original amino acid in the unmodified starting protein would result in the desired activity being evolved.

As used herein, high-throughput screening (HTS) refers to processes that test a large number of samples, such as samples of test proteins or cells containing nucleic acids encoding the proteins of interest to identify structures of interest or the identify test compounds that interact with the variant proteins or cells containing them. HTS operations are amenable to automation and are typically computerized to handle sample preparation, assay procedures and the subsequent processing of large volumes of data.

As used herein, the term "restricted," when used in the context of the identification of is-HIT amino acid positions along the protein sequence selected for amino acid replacement and/or the identification of replacing amino acids, means that fewer than all amino acids on the protein-backbone are selected for amino acid replacement; and/or fewer than all of the remaining 19 amino acids available to replace the original amino acid present in the unmodified starting protein are selected for replacement. In particular embodiments of the methods provided herein, the is-HIT amino acid positions are restricted, such that fewer than all amino acids on the protein-backbone are selected for amino acid replacement. In other embodiments, the replacing amino acids are restricted, such that fewer than all of the remaining 19 amino acids available to replace the native amino acid present in the unmodified starting protein are selected as replacing amino acids. In a particular embodiment, both of the scans to identify is-HIT amino acid positions and the replacing amino acids are restricted, such that fewer than all amino acids on the protein-backbone are selected for amino acid replacement and fewer than all of the remaining 19 amino acids available to replace the native amino acid are selected for replacement.

As used herein, "candidate LEADs," are mutant proteins that are contemplated as potentially having an alteration in any attribute, chemical, physical or biological property in which such alteration is sought. In the methods herein, candidate LEADs are generally generated by systematically replacing is-HITS loci in a protein or a domain thereof with typically a restricted subset, or all, of the remaining 19 amino acids, such as obtained using PAM analysis. Candidate LEADs can be generated by other methods known to those of skill in the art tested by the high throughput methods herein.

As used herein, "LEADs" are "candidate LEADs" whose activity has been demonstrated to be optimized or improved for the particular attribute, chemical, physical or biological property. For purposes herein a "LEAD" typically has activity with respect to the function of interest that differs by at least 10%, 20%, 30%, 40%, 50%, 60%, 70%, 80%, 90%, 100%, 150%, 200% or more from the unmodified and/or wild type (native) protein. In certain embodiments, the change in activity is at least about 10%, 20%, 30%, 40%, 50%, 60%, 70%, 80%, 90% or 100%, of the activity of the unmodified target protein. In other embodiments, the change in activity is not more than about 10%, 20%, 30%, 40%, 50%, 60%, 70%, 80%, 90% or 100%, of the activity of the unmodified target protein. In yet other embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more greater than the activity of the unmodified target protein. The desired alteration, which can be either an increase or a reduction in activity, will depend upon the function or property of interest (e.g., ±10%, ±20%, etc.). The LEADs may be further optimized by replacement of a plurality (2 or more) of "is-HIT" target positions on the same protein molecule to generate "super-LEADs."

As used herein, the term "super-LEAD" refers to protein mutants (variants) obtained by combining the single mutations present in two or more of the LEAD molecules into a single protein molecule. Accordingly, in the context of the modified proteins provided herein, the phrase "proteins comprising one or more single amino acid replacements" encompasses any combination of two or more of the mutations described herein for a respective protein. For example, the modified proteins provided herein having one or more single amino acid replacements can have can have any combination of 2, 3, 4, 5, 6, 7, 8, 9, 10, 11, 12, 13, 14, 15, 16, 17, 18, 19, 20 or more of the amino acid replacements at the disclosed replacement positions. The collection of super-LEAD mutant molecules is generated, tested and phenotypically characterized one-by-one in addressable arrays. Super-LEAD mutant molecules are such that each molecule contains a variable number and type of LEAD mutations. Those molecules displaying further improved fitness for the particular feature being evolved, are referred to as super-LEADs. Super-LEADs can be generated by other methods known to those of skill in the art and tested by the high throughput methods herein. For purposes herein a super-LEAD typically has activity with respect to the function of interest that differs from the improved activity of a LEAD by a desired amount, such as at least 10%, 20%, 30%, 40%, 50%, 60%, 70%, 80%, 90%, 100%, 150%, 200% or more from at least one of the LEAD mutants from which it is derived. As with LEADs, the change in the activity for super-LEADs is dependent upon the activity that is being "evolved." The desired alteration, which can be either an increase or a reduction in activity, will depend upon the function or property of interest.

As used herein, a recitation that modified protein has more antiviral activity (or other activity) than antiproliferative activity (or another activity) compared to the unmodified cytokine, is comparing the absolute value of the change in each activity compared to wild type.

As used herein, the phrase "altered loci" refers to the is-HIT amino acid positions in the LEADs or super-LEADs that are replaced with different replacing amino acids, resulting in the desired altered phenotype or activity.

As used herein, an exposed residue presents more than 15% of its surface exposed to the solvent.

As used herein, the phrase "structural homology" refers to the degree of coincidence in space between two or more protein backbones. Protein backbones that adopt the same protein structure, fold and show similarity upon three-dimensional structural superposition in space can be considered structurally homologous. Structural homology is not based on sequence homology, but rather on three-dimension homology. Two amino acids in two different proteins said to be homologous based on structural homology between those proteins, do not necessarily need to be in sequence-based homologous regions. For example, protein backbones that have a root mean squared (RMS) deviation of less than 3.5, 3.0, 2.5, 2.0, 1.7 or 1.5 angstroms (Å) at a given space position or defined region between each other can be considered to be structurally homologous in that region, and are referred to herein as having a "high coincidence" between their backbones. It is contemplated herein that substantially equivalent (e.g., "structurally related") amino acid positions that are located on two or more different protein sequences that share a certain degree of structural homology will have comparable functional tasks; also referred to herein as "structurally homologous loci." These two amino acids than can be said to be "structurally similar" or "structurally related" with each other, even if their precise primary linear positions on the amino acid sequences, when these sequences are aligned, do not match with each other. Amino acids that are "structurally related" can be far away from each other in the primary protein sequences, when these sequences are aligned following the rules of classical sequence homology.

As used herein, a structural homolog is a protein that is generated by structural homology.

As used herein, the phrase "unmodified target protein," "unmodified protein" or "unmodified cytokine," or grammatical variations thereof, refers to a starting protein that is selected for modification using the methods provided herein. The starting unmodified target protein can be the naturally occurring, wild type form of a protein. In addition, the starting unmodified target protein may have previously been altered or mutated, such that it differs from the native wild type isoform, but is nonetheless referred to herein as a starting unmodified target protein relative to the subsequently modified proteins produced herein. Thus, existing proteins known in the art that have previously been modified to have a desired increase or decrease in a particular biological activity compared to an unmodified reference protein can be selected and used herein as the starting "unmodified target protein." For example, a protein that has been modified from its native form by one or more single amino acid changes and possesses either an increase or decrease in a desired activity, such as resistance to proteolysis, can be utilized with the methods provided herein as the starting unmodified target protein for further modification of either the same or a different biological activity.

Likewise, existing proteins known in the art that have previously been modified to have a desired increase or decrease in a particular biological activity compared to an unmodified reference protein can be selected and used herein for identification of structurally homologous loci on other structurally homologous target proteins. For example, a protein that has been modified by one or more single amino acid changes and possesses either an increase or decrease in a desired activity, such as resistance to proteolysis, can be utilized with the methods provided herein to identify on structurally homologous target proteins, corresponding structurally homologous loci that can be replaced with suitable replacing amino acids and tested for either an increase or decrease in the desired biological activity.

As used herein, the phrase "only one amino acid replacement occurs on each target protein" refers to the modification of a target protein, such that it differs from the unmodified form of the target protein by a single amino acid change. For example, in one embodiment, mutagenesis is performed by the replacement of a single amino acid residue at only one is-HIT target position on the protein backbone (e.g., "one-by-one" in addressable arrays), such that each individual mutant generated is the single product of each single mutagenesis reaction. The single amino acid replacement mutagenesis reactions are repeated for each of the replacing amino acids selected at each of the is-HIT target positions. Thus, a plurality of mutant protein molecules are produced, whereby each mutant protein contains a single amino acid replacement at only one of the is-HIT target positions.

As used herein, the phrase "pseudo-wild type," in the context of single or multiple amino acid replacements, are those amino acids that, while different from the original, such as native, amino acid at a given amino acid position, can replace the native one at that position without introducing any measurable change in a particular protein activity. A population of sets of nucleic acid molecules encoding a collection of mutant molecules is generated and phenotypically characterized such that proteins with amino acid sequences different from the original amino acid, but that still elicit substantially the same level (i.e., at least 10%, 50%, 70%, 90%, 95%, 100%, depending upon the protein) and type of desired activity as the original protein are selected.

As used herein, biological and pharmacological activity includes any activity of a biological pharmaceutical agent and includes, but is not limited to, resistance to proteolysis, biological efficiency, transduction efficiency, gene/transgene expression, differential gene expression and induction activity, titer, progeny productivity, toxicity, cytotoxicity, immunogenicity, cell proliferation and/or differentiation activity, anti-viral activity, morphogenetic activity, teratogenetic activity, pathogenetic activity, therapeutic activity, tumor suppressor activity, ontogenetic activity, oncogenetic activity, enzymatic activity, pharmacological activity, cell/tissue tropism and delivery.

As used herein, a "small region" on a polypeptide is relative term depending upon the size of the polypeptide, but typically refers to a region that is less than about 10%, 15%, 25% of the protein. A large region is greater than about 10%, 15% or 25% of the protein.

As used herein, "output signal" refers to parameters that can be followed over time and, if desired, quantified. For example, when a recombinant protein is introduced into a cell, the cell containing the recombinant protein undergoes a number of changes. Any such change that can be monitored and used to assess the transformation or transfection, is an output signal, and the cell is referred to as a reporter cell; the encoding nucleic acid is referred to as a reporter gene, and the construct that includes the encoding nucleic acid is a reporter construct. Output signals include, but are not limited to, enzyme activity, fluorescence, luminescence, amount of product produced and other such signals. Output signals include expression of a gene or gene product, including heterologous genes (transgenes) inserted into the plasmid virus. Output signals are a function of time ("t") and are related to the amount of protein used in the composition. For higher concentrations of protein, the output signal can be higher or lower. For any particular concentration, the output signal increases as a function of time until a plateau is reached. Output signals can also measure the interaction between cells, expressing heterologous genes, and biological agents As used herein, the activity of an IFNα-2b or IFNα-2a protein refers to any biological activity that can be assessed. In particular, herein, the activity assessed for the IFNα-2b or IFNα-2a proteins is resistance to proteolysis, antiviral activity and cell proliferation activity.

As used herein, the Hill equation is a mathematical model that relates the concentration of a drug (i.e., test compound or substance) to the response measured $$y = \frac{y_{max}[D]^x}{[D]^n + [D_{50}]^n}$$

where y is the variable measured, such as a response, signal, $y_{max}$ is the maximal response achievable, [D] is the molar concentration of a drug, [D50] is the concentration that produces a 50% maximal response to the drug, n is the slope parameter, which is 1 if the drug binds to a single site and with no cooperativity between or among sites. A Hill plot is $\log_{10}$ of the ratio of ligand-occupied receptor to free receptor vs. log [D] (M). The slope is n, where a slope of greater than 1 indicates cooperativity among binding sites, and a slope of less than 1 can indicate heterogeneity of binding. This general equation has been employed for assessing interactions in complex biological systems (see, published International PCT application No. WO 01/44809 based on PCT No. PCT/FR00/03503, see also, the EXAMPLES).

As used herein, in the Hill-based analysis (published International PCT application No. WO 01/44809 based on PCT No. PCT/FR00/03503), the parameters, $\pi$, $\kappa$, $\tau$, $\epsilon$, $\eta$, $\theta$, are as follows:

$\pi$ is the potency of the biological agent acting on the assay (cell-based) system;

$\kappa$ is the constant of resistance of the assay system to elicit a response to a biological agent;

$\epsilon$ is the global efficiency of the process or reaction triggered by the biological agent on the assay system;

$\tau$ is the apparent titer of the biological agent;

$\theta$ is the absolute titer of the biological agent; and $\eta$ is the heterogeneity of the biological process or reaction.

In particular, as used herein, the parameters $\pi$ (potency) or $\kappa$ (constant of resistance) are used to respectively assess the potency of a test agent to produce a response in an assay system and the resistance of the assay system to respond to the agent.

As used herein, $\epsilon$ (efficiency), is the slope at the inflexion point of the Hill curve (or, in general, of any other sigmoidal or linear approximation), to assess the efficiency of the global reaction (the biological agent and the assay system taken together) to elicit the biological or pharmacological response.

As used herein, $\tau$ (apparent titer) is used to measure the limiting dilution or the apparent titer of the biological agent.

As used herein, $\theta$ (absolute titer), is used to measure the absolute limiting dilution or titer of the biological agent.

As used herein, $\eta$ (heterogeneity) measures the existence of discontinuous phases along the global reaction, which is reflected by an abrupt change in the value of the Hill coefficient or in the constant of resistance.

As used herein, a population of sets of nucleic acid molecules encoding a collection (library) of mutants refers to a collection of plasmids or other vehicles that carry (encode) the gene variants, such that individual plasmids or other individual vehicles carry individual gene variants. Each element (member) of the collection is physically separated from the others, such as individually in an appropriate addressable array, and has been generated as the single product of an independent mutagenesis reaction. When & collection (library) of such proteins is contemplated, it will be so-stated.

As used herein, a "reporter cell" is the cell that "reports," i.e., undergoes the change, in response to a condition, such as, for example, exposure to a protein or a virus or to a change it its external or internal environment.

As used herein, "reporter" or "reporter moiety" refers to any moiety that allows for the detection of a molecule of interest, such as a protein expressed by a cell. Reporter moieties include, but are not limited to, for example, fluorescent proteins, such as red, blue and green fluorescent proteins; LacZ and other detectable proteins and gene products. For expression in cells, nucleic acid encoding the reporter moiety can be expressed as a fusion protein with a protein of interest or under to the control of a promoter of interest.

As used herein, phenotype refers to the physical, physiological or other manifestation of a genotype (a sequence of a gene). In methods herein, phenotypes that result from alteration of a genotype are assessed.

As used herein, "activity" means in the largest sense of the term any change in a system (either biological, chemical or physical system) of any nature (changes in the amount of product in an enzymatic reaction, changes in cell proliferation, in immunogenicity, in toxicity) caused by a protein or protein mutant when they interact with that system. In addition, the term "activity," "higher activity" or "lower activity" as used herein in reference to resistance to proteases, proteolysis, incubation with serum or with blood, means the ratio or residual biological (antiviral) activity between "after" protease/blood or serum treatment and "before" protease/blood or serum treatment.

As used herein, activity refers to the function or property to be evolved. An active site refers to a site(s) responsible or that participates in conferring the activity or function. The activity or active site evolved (the function or property and the site conferring or participating in conferring the activity) can have nothing to do with natural activities of a protein. For example, it could be an "active site" for conferring immunogenicity (immunogenic sites or epitopes) on a protein.

As used herein, treatment means any manner in which the symptoms of a condition, disorder or disease are ameliorated or otherwise beneficially altered. Treatment also encompasses any pharmaceutical use of the modified cytokines and compositions provided herein.

As used herein, cytokine-mediated or cytokine-involved diseases refer to diseases in which cytokines potentiate, cause or are involved in the disease process or to diseases in which administration of a cytokine is ameliorative of a disease or symptoms thereof. Cytokines can be used in immunotherapeutic therapies or protocols.

As used herein, the amino acids, which occur in the various amino acid sequences appearing herein, are identified according to their known, three-letter or one-letter abbreviations (see, Table 1). The nucleotides, which occur in the various nucleic acid fragments, are designated with the standard single-letter designations used routinely in the art.

As used herein, amino acid residue refers to an amino acid formed upon chemical digestion (hydrolysis) of a polypeptide at its peptide linkages. The amino acid residues described herein are presumed to be in the "L" isomeric form. Residues in the "D" isomeric form, which are so-designated, can be substituted for any L-amino acid residue, as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243:3552-3559, 1969, and adopted at 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | tyrosine |
| G | Gly | glycine |
| F | Phe | phenylalanine |
| M | Met | methionine |
| A | Ala | alanine |
| S | Ser | serine |
| I | Ile | isoleucine |
| L | Leu | leucine |
| T | Thr | threonine |
| V | Val | valine |
| P | Pro | proline |
| K | Lys | lysine |
| H | His | histidine |

TABLE 1-continued

Table of Correspondence

| SYMBOL | | |
|---|---|---|
| 1-Letter | 3-Letter | AMINO ACID |
| Q | Gln | glutamine |
| E | Glu | glutamic acid |
| Z | Glx | Glu and/or Gln |
| W | Trp | tryptophan |
| R | Arg | arginine |
| D | Asp | aspartic acid |
| N | Asn | asparagine |
| B | Asx | Asn and/or Asp |
| C | Cys | cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues or to an amino-terminal group such as NH2 or to a carboxyl-terminal group such as COOH.

As used herein, nucleic acids include DNA, RNA and analogs thereof, including protein nucleic acids (PNA) and mixtures thereof. Nucleic acids can be single or double stranded. When referring to probes or primers, optionally labeled, with a detectable label, such as a fluorescent or radiolabel, single-stranded molecules are contemplated. Such molecules are typically of a length such that they are statistically unique of low copy number (typically less than 5, generally less than 3) for probing or priming a library. Generally a probe or primer contains at least 14, 16 or 30 contiguous of sequence complementary to or identical a gene of interest. Probes and primers can be 10, 14, 16, 20, 30, 50, 100 or more nucleic acid bases long.

Therefore, as used herein, the term "identity" represents a comparison between a test and a reference polypeptide or polynucleotide. For example, a test polypeptide can be defined as any polypeptide that is 90% or more identical to a reference polypeptide.

As used herein, "corresponding structurally-related" positions on two or more proteins, such as the IFNα-2b protein and other cytokines, refers those amino acid positions determined based upon structural homology to maximize tri-dimensional overlapping between proteins.

As used herein, the term at least "90% identical to" refers to percent identities from 90 to 100% relative to the reference polypeptides. Identity at a level of 90% or more is indicative of the fact that, assuming for exemplification purposes a test and reference polypeptide length of 100 amino acids are compared. No more than 10% (i.e., 10 out of 100) amino acids in the test polypeptide differ from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences are defined as nucleic acid or amino acid substitutions, or deletions.

As used herein, the phrase "sequence-related proteins" refers to proteins that have at least 50%, at least 60%, at least 70%, at least 80%, at least 90%, at least 95% amino acid identity or homology with each other.

As used herein, families of non-related proteins or "sequence-non-related proteins" refers to proteins that have less than 50%, less than 40%, less than 0%, less than 20% amino acid identity or homology with each other.

As used herein, it also is understood that the terms "substantially identical" or "similar" varies with the context as understood by those skilled in the relevant art.

As used herein, heterologous or foreign nucleic acid, such as DNA and RNA, are used interchangeably and refer to DNA or RNA that does not occur naturally as part of the genome in which it is present or which is found in a location or locations in the genome that differ from that in which it occurs in nature. Heterologous nucleic acid is generally not endogenous to the cell into which it is introduced, but has been obtained from another cell or prepared synthetically. Generally, although not necessarily, such nucleic acid encodes RNA and proteins that are not normally produced by the cell in which it is expressed. Heterologous DNA herein encompasses any DNA or RNA that one of skill in the art would recognize or consider as heterologous or foreign to the cell in which it is expressed. Heterologous DNA and RNA can also encode RNA or proteins that mediate or alter expression of endogenous DNA by affecting transcription, translation, or other regulatable biochemical processes. Examples of heterologous nucleic acid include, but are not limited to, nucleic acid that encodes traceable marker proteins, such as a protein that confers drug resistance, nucleic acid that encodes therapeutically effective substances, such as anti-cancer agents, enzymes and hormones, and DNA that encodes other types of proteins, such as antibodies.

Hence, herein heterologous DNA or foreign DNA, includes a DNA molecule not present in the exact orientation and position as the counterpart DNA molecule found in the genome. It can also refer to a DNA molecule from another organism or species (i.e., exogenous).

As used herein, a therapeutically effective dose refers to that amount of the compound sufficient to result in amelioration of symptoms of disease.

As used herein, isolated with reference to a nucleic acid molecule or polypeptide or other biomolecule means that the nucleic acid or polypeptide has separated from the genetic environment from which the polypeptide or nucleic acid were obtained. It can also mean altered from the natural state. For example, a polynucleotide or a polypeptide naturally present in a living animal is not "isolated," but the same polynucleotide or polypeptide separated from the coexisting materials of its natural state is "isolated," as the term is employed herein. Thus, a polypeptide or polynucleotide produced and/or contained within a recombinant host cell is considered isolated. Also intended as an "isolated polypeptide" or an "isolated polynucleotide" are polypeptides or polynucleotides that have been purified, partially or substantially, from a recombinant host cell or from a native source. For example, a recombinantly produced version of a compound can be substantially purified by the one-step method described in Smith et al., Gene, 67:31-40, 1988. The terms isolated and purified are sometimes used interchangeably.

Thus, by "isolated" is meant that the nucleic is free of the coding sequences of those genes that, in the naturally-occurring genome of the organism (if any) immediately flank the gene encoding the nucleic acid of interest. Isolated DNA can be single-stranded or double-stranded, and can be genomic DNA, cDNA, recombinant hybrid DNA, or synthetic DNA. It can be identical to a starting DNA sequence, or can differ from such sequence by the deletion, addition, or substitution of one or more nucleotides.

Isolated or purified as it refers to preparations made from biological cells or hosts means any cell extract containing the indicated DNA or protein including a crude extract of the DNA or protein of interest. For example, in the case of a protein, a purified preparation can be obtained following an individual technique or a series of preparative or biochemical techniques and the DNA or protein of interest can be present at various degrees of purity in these preparations. The procedures can include for example, but are not limited to, ammonium sulfate fractionation, gel filtration, ion exchange change chromatography, affinity chromatography, density gradient centrifugation and electrophoresis.

A preparation of DNA or protein that is "substantially pure" or "isolated" should be understood to mean a preparation free from naturally occurring materials with which such DNA or protein is normally associated in nature. "Essentially pure" should be understood to mean a "highly" purified preparation that contains at least 95% of the DNA or protein of interest.

A cell extract that contains the DNA or protein of interest should be understood to mean a homogenate preparation or cell-free preparation obtained from cells that express the protein or contain the DNA of interest. The term "cell extract" is intended to include culture media, especially spent culture media from which the cells have been removed.

As used herein, "a targeting agent" refers to any molecule that can bind another target-molecule, such as an antibody, receptor, or ligand.

As used herein, receptor refers to a biologically active molecule that specifically binds to (or with) other molecules. The term "receptor protein" can be used to more specifically indicate the proteinaceous nature of a specific receptor.

As used herein, recombinant refers to any progeny formed as the result of genetic engineering.

As used herein, a promoter region refers to the portion of DNA of a gene that controls transcription of the DNA to which it is operatively linked. The promoter region includes specific sequences of DNA that are sufficient for RNA polymerase recognition, binding and transcription initiation. This portion of the promoter region is referred to as the promoter. In addition, the promoter region includes sequences that modulate this recognition, binding and transcription initiation activity of the RNA polymerase. These sequences can be cis acting or can be responsive to trans acting factors. Promoters, depending upon the nature of the regulation, can be constitutive or regulated.

As used herein, the phrase "operatively linked" generally means the sequences or segments have been covalently joined into one piece of DNA, whether in single or double stranded form, whereby control or regulatory sequences on one segment control or permit expression or replication or other such control of other segments. The two segments are not necessarily contiguous. For gene expression a DNA sequence and a regulatory sequence(s) are connected in such a way to control or permit gene expression when the appropriate molecular, e.g., transcriptional activator proteins, are bound to the regulatory sequence(s).

As used herein, production by recombinant means by using recombinant DNA methods means the use of the well known methods of molecular biology for expressing proteins encoded by cloned DNA, including cloning expression of genes and methods, such as gene shuffling and phage display with screening for desired specificities.

As used herein, a splice variant refers to a variant produced by differential processing of a primary transcript of genomic DNA that results in more than one type of mRNA.

As used herein, a composition refers to any mixture of two or more products or compounds. It can be a solution, a suspension, liquid, powder, a paste, aqueous, non-aqueous or any combination thereof.

As used herein, a combination refers to any association between two or more items.

As used herein, substantially identical to a product means sufficiently similar so that the property of interest is sufficiently unchanged so that the substantially identical product can be used in place of the product.

As used herein, the term "vector" refers to a nucleic acid molecule capable of transporting another nucleic acid to which it has been linked. One type of exemplary vector is an episome, i.e., a nucleic acid capable of extra-chromosomal replication. Exemplary vectors are those capable of autonomous replication and/or expression of nucleic acids to which they are linked. Vectors capable of directing the expression of genes to which they are operatively linked are referred to herein as "expression vectors." In general, expression vectors of utility in recombinant DNA techniques are often in the form of "plasmids" which refer generally to circular double stranded DNA loops which, in their vector form are not bound to the chromosome. "Plasmid" and "vector" are used interchangeably as the plasmid is the most commonly used form of vector. Other such other forms of expression vectors that serve equivalent functions and that become known in the art subsequently hereto.

As used herein, vector also is used interchangeable with "virus vector" or "viral vector. In this case, which will be clear from the context, the "vector" is not self-replicating. Viral vectors are engineered viruses that are operatively linked to exogenous genes to transfer (as vehicles or shuttles) the exogenous genes into cells.

As used herein, transduction refers to the process of gene transfer into and expression in mammalian and other cells mediated by viruses. Transfection refers to the process when mediated by plasmids.

As used herein, transformation refers to the process of gene transfer into and expression in bacterial cells mediated by plasmids.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for the gene or allele. When a subject has two different alleles of a gene, the subject is said to be heterozygous for the gene. Alleles of a specific gene can differ from each other in a single nucleotide, or several nucleotides, and can include substitutions, deletions, and insertions of nucleotides. An allele of a gene also can be a form of a gene containing a mutation.

As used herein, the term "gene" or "recombinant gene" refers to a nucleic acid molecule comprising an open reading frame and including at least one exon and (optionally) an intron sequence. A gene can be either RNA or DNA. Genes can include regions preceding and following the coding region (leader and trailer).

As used herein, "intron" refers to a DNA sequence present in a given gene which is spliced out during mRNA maturation.

As used herein, "nucleotide sequence complementary to the nucleotide sequence set forth in SEQ ID NO:" refers to the nucleotide sequence of the complementary strand of a nucleic acid strand having the particular SEQ ID NO:. The term "complementary strand" is used herein interchangeably with the term "complement." The complement of a nucleic acid strand can be the complement of a coding strand or the complement of a non-coding strand. When referring to double stranded nucleic acids, the complement of a nucleic acid having a particular SEQ ID NO: refers to the complementary strand of the strand set forth in the particular SEQ ID NO: or to any nucleic acid having the nucleotide sequence of the complementary strand of the particular SEQ ID NO:. When referring to a single stranded nucleic acid having a nucleotide sequence corresponding to a particular SEQ ID NO:, the complement of this nucleic acid is a nucleic acid having a nucleotide sequence which is complementary to that of the particular SEQ ID NO:.

As used herein, the term "coding sequence" refers to that portion of a gene that encodes an amino acid sequence of a protein.

As used herein, the term "sense strand" refers to that strand of a double-stranded nucleic acid molecule that has the sequence of the mRNA that encodes the amino acid sequence encoded by the double-stranded nucleic acid molecule.

As used herein, the term "anti sense strand" refers to that strand of a double-stranded nucleic acid molecule that is the complement of the sequence of the mRNA that encodes the amino acid sequence encoded by the double-stranded nucleic acid molecule.

As used herein, an "array" refers to a collection of elements, such as nucleic acid molecules, containing three or more members. An addressable array is one in which the members of the array are identifiable, typically by position on a solid phase support or by virtue of an identifiable or detectable label, such as by color, fluorescence, electronic signal (i.e., RF, microwave or other frequency that does not substantially alter the interaction of the molecules of interest), bar code or other symbology, chemical or other such label. In certain embodiments, the members of the array are immobilized to discrete identifiable loci on the surface of a solid phase or directly or indirectly linked to or otherwise associated with the identifiable label, such as affixed to a microsphere or other particulate support (herein referred to as beads) and suspended in solution or spread out on a surface.

As used herein, a "support" (also referred to as a matrix support, a matrix, an insoluble support or solid support) refers to any solid or semisolid or insoluble support to which a molecule of interest, typically a biological molecule, organic molecule or biospecific ligand is linked or contacted. Such materials include any materials that are used as affinity matrices or supports for chemical and biological molecule syntheses and analyses, such as, but are not limited to: polystyrene, polycarbonate, polypropylene, nylon, glass, dextran, chitin, sand, pumice, agarose, polysaccharides, dendrimers, buckyballs, polyacryl-amide, silicon, rubber, and other materials used as supports for solid phase syntheses, affinity separations and purifications, hybridization reactions, immunoassays and other such applications. The matrix herein can be particulate or can be in the form of a continuous surface, such as a microtiter dish or well, a glass slide, a silicon chip, a nitrocellulose sheet, nylon mesh, or other such materials. When particulate, typically the particles have at least one dimension in the 5-10 mm range or smaller. Such particles, referred collectively herein as "beads," are often, but not necessarily, spherical. Such reference, however, does not constrain the geometry of the matrix, which can be any shape, including random shapes, needles, fibers, and elongated. Roughly spherical "beads," particularly microspheres that can be used in the liquid phase, also are contemplated. The "beads" can include additional components, such as magnetic or paramagnetic particles (see, e.g., Dynabeads (Dynal, Oslo, Norway)) for separation using magnets, as long as the additional components do not interfere with the methods and analyses herein.

As used herein, a "matrix" or "support particles" refers to matrix materials that are in the form of discrete particles. The particles have any shape and dimensions, but typically have at least one dimension that is 100 mm or less, 50 mm or less, 10 mm or less, 1 mm or less, 100 µm or less, 50 µm or less and typically have a size that is 100 mm$^3$ or less, 50 mm$^3$ or less, 10 mm$^3$ or less, and 1 mm$^3$ or less, 100 µm$^3$ or less a can be order of cubic microns. Such particles are collectively called "beads."

As used herein, the abbreviations for any protective groups, amino acids and other compounds, are, unless indicated otherwise, in accord with their common usage, recognized abbreviations, or the IUPAC-IUB Commission on Biochemical Nomenclature (see, *Biochem.*, 11:942-944 (1972)).

B. Directed Evolution

To date, there have been three general approaches described for protein directed evolution based on mutagenesis.

1. Pure Random Mutagenesis

Random mutagenesis methodology requires that the amino acids in the starting protein sequence are replaced by all (or a group) of the 20 amino acids. Either single or multiple replacements at different amino acid positions are generated on the same molecule, at the same time. The random mutagenesis method relies on a direct search for fitness improvement based on random amino acid replacement and sequence changes at multiple amino acid positions. In this approach neither the amino acid position (first dimension) nor the amino acid type (second dimension) are restricted; and everything possible is generated and tested. Multiple replacements can randomly happen at the same time on the same molecule. For example, random mutagenesis methods are widely used to develop antibodies with higher affinity for its ligand, by the generation of random-sequence libraries of antibody molecules, followed by expression and screening using filamentous phages.

2. Restricted Random Mutagenesis

Restricted random mutagenesis methods introduce either all of the 20 amino acids or DNA-biased residues. The bias is based on the sequence of the DNA and not on that of the protein, in a stochastic or semi-stochastic manner, respectively, within restricted or predefined regions of the protein, known in advance to be involved in the biological activity being "evolved." This method relies on a direct search for fitness improvement based on random amino acid replacement and sequence changes at either restricted or multiple amino acid positions. In this approach the scanning can be restricted to selected amino acid positions and/or amino acid types, while material changes continue to be random in position and type. For example, the amino acid position can be restricted by prior selection of the target region to be mutated (selection of target region is based upon prior knowledge on protein structure/function); while the amino acid type is not primarily restricted as replacing amino acids are stochastically or at most "semi-stochastically" chosen. As an example, this method is used to optimize known binding sites on proteins, including hormone-receptor systems and antibody-epitope systems.

3. Non-Restricted Rational Mutagenesis

Rational mutagenesis is a two-step process and is described in co-pending U.S. application Ser. No. 10/022,249. Briefly, the first step requires amino acid scanning where all and each of the amino acids in the starting protein sequence are replaced by a third amino acid of reference (e.g., alanine). Only a single amino acid is replaced on each protein molecule at a time. A collection of protein molecules having a single amino acid replacement is generated such that molecules differ from each other by the amino acid position at which the replacement has taken place. Mutant DNA molecules are designed, generated by mutagenesis and cloned individually, such as in addressable arrays, such that they are physically separated from each other and such that each one is the single product of an independent mutagenesis reaction. Mutant protein molecules derived from the collection of mutant nucleic acid molecules also are physically separated from each other, such as by formatting in addressable arrays. Activity assessment on each protein molecule allows for the identification of those amino acid positions that result in a drop in activity when replaced, thus indicating the involvement of that particular amino acid position in the protein's biological activity and/or conformation that leads to fitness of the particular feature being evolved. Those amino acid positions are referred to as HITs. At the second step, a new collection of molecules is generated such that each molecule differs from each of the others by the amino acid present at the individual HIT positions identified in step 1. All 20 amino acids (19 remaining) are introduced at each of the HIT positions identified in step 1; while each individual molecule contains, in principle, one and only one amino acid replacement. Mutant DNA molecules are designed, generated by mutagenesis and cloned individually, such as in addressable arrays, such that they are physically separated from each other and such that each one is the single product of an independent mutagenesis reaction. Mutant protein molecules derived from the collection of mutant DNA molecules also are physically separated from each other, such as by formatting in addressable arrays. Activity assessment then is individually performed on each individual mutant molecule. The newly generated mutants that lead to a desired alteration (such as an improvement) in a protein activity are referred to as LEADs. This method permits an indirect search for activity alteration, such as improvement, based on one rational amino acid replacement and sequence change at a single amino acid position at a time, in search of a new, unpredicted amino acid sequence at some unpredicted regions along a protein to produce a protein that exhibits a desired activity or altered activity, such as better performance than the starting protein.

In this approach, neither the amino acid position nor the replacing amino acid type are restricted. Full length protein scanning is performed during the first step to identify HIT positions, and then all 20 amino acids are tested at each of the HIT positions, to identify LEAD sequences; while, as a starting point, only one amino acid at a time is replaced on each molecule. The selection of the target region (HITs and surrounding amino acids) for the second step is based upon experimental data on activity obtained in the first step. Thus, no prior knowledge of protein structure and/or function is necessary. Using this approach, LEAD sequences have been found on proteins that are located at regions of the protein not previously known to be involved in the particular biological activity being optimized; thus emphasizing the power of this approach to discover unpredictable regions (HITs) as targets for fitness improvement.

C. 2-Dimensional Rational Scanning (2D Scanning)

The 2-Dimensional rational scanning (or "2-dimensional scanning") methods for protein rational evolution provided herein (see, also copending U.S. application Ser. No. 10/658,355, filed Sep. 08, 2003, based on U.S. provisional application Ser. Nos. 60/457,063 and 60/410,258) are based on scanning over two dimensions. The first dimension scanned is amino acid position along the protein sequence to identify is-HIT target positions, and the second dimension is the amino acid type selected for replacing a particular is-HIT amino acid position. An advantage of the 2-dimensional scanning methods provided herein is that at least one, and typically both, of the amino acid position scan and/or the replacing amino acid scan can be restricted such that fewer than all amino acids on the protein-backbone are selected for amino acid replacement; and/or fewer than all of the remaining 19 amino acids available to replace an original, such as native, amino acid are selected for replacement.

In particular embodiments, based on i) the particular protein properties to be evolved, ii) the protein's amino acid sequence, and iii) the known properties of the individual amino acids, a number of target positions along the protein sequence are selected, in silico, as "is-HIT target positions." This number of is-HIT target positions is as large as possible such that all reasonably possible target positions for the particular feature being evolved are included. In particular, embodiments where a restricted number of is-HIT target positions are selected for replacement, the amino acids selected to replace the is-HIT target positions on the particular protein being optimized can be either all of the remaining 19 amino acids or, more frequently, a more restricted group comprising selected amino acids that are contemplated to have the desired effect on protein activity. In another embodiment, so long as a restricted number of replacing amino acids are used, all of the amino acid positions along the protein backbone can be selected as is-HIT target positions for amino acid replacement. Mutagenesis then is performed by the replacement of single amino acid residues at specific is-HIT target positions on the protein backbone (e.g., "one-by-one," such as in addressable arrays), such that each individual mutant generated is the single product of each single mutagenesis reaction. Mutant DNA molecules are designed, generated by mutagenesis and cloned individually, such as in addressable arrays, such that they are physically separated from each other and that each one is the single product of an independent mutagenesis reaction. Mutant protein molecules derived from the collection of mutant DNA molecules also are physically separated from each other, such as by formatting in addressable arrays. Thus, a plurality of mutant protein molecules are produced. Each mutant protein contains a single amino acid replacement at only one of the is-HIT target positions. Activity assessment is then individually performed on each individual protein mutant molecule, following protein expression and measurement of the appropriate activity. An example of practice of this method is shown in the Example in which mutant IFNα molecules and IFNβ molecules are produced.

The newly generated proteins that lead to altered, typically improvement, in a target protein activity are referred to as LEADs. This method relies on an indirect search for protein improvement for a particular activity, such as increased resistance to proteolysis, based on a rational amino acid replacement and sequence change at single or, in another embodiment, a limited number of amino acid positions at a time. As a result, optimized proteins that have new amino acid sequences at some regions along the protein that perform better (at a particular target activity or other property) than the starting protein are identified and isolated.

1. Identifying In-silico HITs

Provided herein is a method for directed evolution that includes identifying and selecting (using in silico analysis) specific amino acids and amino acid positions (referred to herein as is-HITs) along the protein sequence that are contemplated to be directly or indirectly involved in the feature being evolved. As noted, the 2-dimensional scanning methods provided include the following two-steps. The first step is an in silico search of a target protein's amino acid sequence to identify all possible amino acid positions that potentially can be targets for the activity being evolved. This is effected, for example, by assessing the effect of amino acid residues on the property(ies) to be altered on the protein, using any known standard software. The particulars of the in silico analysis is a function of the property to be modified. For example, in the example herein, a property that is altered resistance of the protein to proteolysis. To determine amino acid residues that are potential targets as is-HITs, in this example, all possible target residues for proteases were first identified. The 3-dimensional structure of the protein was then considered in order to identify surface residues. Comparison of exposed residues with proteolytically cleavable residues yields residues that are targets for change.

Once identified, these amino acid positions or target sequences are referred to as "is-HITs" (in silico HITs). In silico HITs are defined as those amino acid positions (or target positions) that potentially are involved in the "evolving" feature, such as increased resistance to proteolysis. In one embodiment, the discrimination of the is-HITs among all the amino acid positions in a protein sequence is made based on i) the amino acid type at each position in addition to, whenever available but not necessarily, ii) the information on the protein secondary or tertiary structure. In silico HITs constitute a collection of mutant molecules such that all possible amino acids, amino acid positions or target sequences potentially involved in the evolving feature are represented. No strong theoretical discrimination among amino acids or amino acid positions is made at this stage.

In silico HIT positions are spread over the full length of the protein sequence. In one embodiment, only a single is-HIT amino acid at a time is replaced on the target protein. In another embodiment, a limited number of is-HIT amino acids are replaced at the same time on the same target protein molecule. The selection of target regions (is-HITs and surrounding amino acids) for the second step is based upon rational assumptions and predictions. No prior knowledge of protein structure/function is necessary. Hence, the 2-dimensional scanning methodology provided herein does not require any previous knowledge of the 3-dimensional conformational structure of the protein.

Any protein known or otherwise available to those of skill in the art is suitable for modification using the directed evolution methods provided herein, including cytokines (e.g., IFNα-2b) or any other proteins that have previously been mutated or optimized.

A variety of parameters can be analyzed to determine whether or not a particular amino acid on a protein might be involved in the evolving feature. For example, the information provided by crystal structures of proteins can be rationally exploited in order to perform a computer-assisted (in silico) analysis towards the prediction of variants with desired features. In a particular embodiment, a limited number of initial premises (typically no more than 2) are used to determine the in silico HITs. In other embodiments, the number of premises used to determine the in silico hits can range from 1 to 10 premises, including no more than 9, no more than 8, no more than 7, no more than 6, no more than 5, no more than 4, no more than 3, but are typically no more than 2 premises. It is important to the methods provided herein that the number of initial premises be kept to a minimum, so as to maintain the number of potential is-HITs at a maximum (here is where the methods provided are not limited by too much prediction based on theoretical assumptions). When two premises are employed, the first condition is typically the amino acid type itself, which is directly linked to the nature of the evolving feature. For example, if the goal were to change the optimum pH for an enzyme, then the replacing amino acids selected at this step for the replacement of the original sequence would be only those with a certain pKa value. The second premise is typically related to the specific position of those amino acids along the protein structure. For example, some amino acids might be discarded if they are not expected to be exposed enough to the solvent, even when they might have appropriate pKa values.

During the first step of identification of is-HITs according to the methods provided herein, each individual amino acid along the protein sequence is considered individually to assess whether it is a candidate for is-HIT. This search is done one-by-one and the decision on whether the amino acid is considered to be a candidate for a is-HIT is based on (1) the amino acid type itself; (2) the position on the amino acid sequence and protein structure if known; and (3) the predicted interaction between that amino acid and its neighbors in sequence and space.

Using the 3D-scanning methods provided herein, once one protein within a family of proteins (e.g., IFNα-2b within the cytokine family) is optimized using the methods provided herein for generating LEAD mutants, is-HITs can be identified on other or all proteins within a particular family by identifying the corresponding amino acid positions therein using structural homology analysis (based upon comparisons of the 3-D structures of the family members with original protein to identify corresponding residues for replacement) as described hereinafter. The is-HITs on family identified in this manner then can be subjected to the next step of identifying replacing amino acids and further assayed to obtain LEADs or super-LEADs as described herein.

2. Identifying Replacing Amino Acids

Once the is-HITs target positions are selected, the next step is identifying those amino acids that will replace the original, such as native, amino acid at each is-HIT position to alter the activity level for the particular feature being evolved. The set of replacing amino acids to be used to replace the original, such as native, amino acid at each is-HIT position can be different and specific for the particular is-HIT position. The choice of the replacing amino acids takes into account the need to preserve the physicochemical properties such as hydrophobicity, charge and polarity, of essential (e.g., catalytic, binding, etc.) residues. The number of replacing amino acids, of the remaining 19 non-native (or non-original) amino acids, that can be used to replace a particular is-HIT target position ranges from 1 up to about 19, from 1 up to about 15, from 1 up to about 10, from 1 up to about 9, from 1 up to about 8, from 1 up to about 7, from 1 up to about 6, from 1 up to about 5, from 1 up to about 4, from 1 up to about 3, or from 1 to 2 amino acid replacements.

Numerous methods of selecting replacing amino acids (also referred to herein as "replacement amino acids") are well known in the art. Protein chemists determined that certain amino acid substitutions commonly occur in related proteins from different species. As the protein still functions with these substitutions, the substituted amino acids are compatible with protein structure and function. Often, these substitutions are to a chemically similar amino acid, but other types of changes, although relatively rare, can also occur.

Knowing the types of changes that are most and least common in a large number of proteins can assist with predicting alignments and amino acid substitutions for any set of protein sequences. Amino acid substitution matrices are used for this purpose.

In amino acid substitution matrices, amino acids are listed across the top of a matrix and down the side, and each matrix position is filled with a score that reflects how often one amino acid would have been paired with the other in an alignment of related protein sequences. The probability of changing amino acid A into amino acid B is assumed to be identical to the reverse probability of changing B into A. This assumption is made because, for any two sequences, the ancestor amino acid in the phylogenetic tree is usually not known. Additionally, the likelihood of replacement should depend on the product of the frequency of occurrence of the two amino acids and on their chemical and physical similarities. A prediction of this model is that amino acid frequencies will not change over evolutionary time (Dayhoff et al., *Atlas of Protein Sequence and Structure*, 5(3):345-352, 1978). Below are several exemplary amino acid substitution matrices, including, but not limited to block substitution matrix (BLOSUM), Jones, Gonnet, Fitch, Feng, McLachlan, Grantham, Miyata, Rao, Risler, Johnson and percent accepted mutation (PAM). Any such method known to those of skill in the art can be employed.

a. Percent Accepted Mutation (PAM)

Dayhoff and coworkers developed a model of protein evolution that resulted in the development of a set of widely used replacement matrices (Dayhoff et al., *Atlas of Protein Sequence and Structure*, 5(3):345-352, 1978) termed percent accepted mutation matrices (PAM). In deriving these matrices, each change in the current amino acid at a particular site is assumed to be independent of previous mutational events at that site. Thus, the probability of change of any amino acid A to amino acid B is the same, regardless of the previous changes at that site and also regardless of the position of amino acid A in a protein sequence.

In the Dayhoff approach, replacement rates are derived from alignments of protein sequences that are at least 85% identical; this constraint ensures that the likelihood of a particular mutation being the result of a set of successive mutations is low. Because these changes are observed in closely related proteins, they represent amino acid substitutions that do not significantly change the function of the protein. Hence, they are called "accepted mutations," as defined as amino acid changes that are accepted by natural selection.

i. PAM Analysis

In particular embodiments of the methods provided herein, "Percent Accepted Mutation" (PAM; Dayhoff et al., *Atlas of Protein Sequence and Structure*, 5(3):345-352, 1978 FIG. 2) PAM values are used to select an appropriate group of replacement amino acids. PAM matrices were originally developed to produce alignments between protein sequences based evolutionary distances. Because, in a family of proteins or homologous (related) sequences, identical or similar amino acids (85% similarity) are shared, conservative substitutions for, or allowed point mutations of the corresponding amino acid residues can be determined throughout an aligned reference sequence. Conservative substitutions of a residue in a reference sequence are those substitutions that are physically and functionally similar to the corresponding reference residues, e.g., that have a similar size, shape, electric charge, chemical properties, including the ability to form bonds such as covalent and hydrogen bonds. Particularly suitable conservative amino acid substitutions are those that show the highest scores and fulfill the PAM matrix criteria in the form of "accepted point mutations." For example, by comparing a family of scoring matrices, Dayhoff et al., *Atlas of Protein Sequence and Structure*, 5(3):345-352, 1978, found a consistently higher score significance when using PAM250 matrix to analyze a variety of proteins, known to be distantly related.

ii. PAM 250

Figure 2:
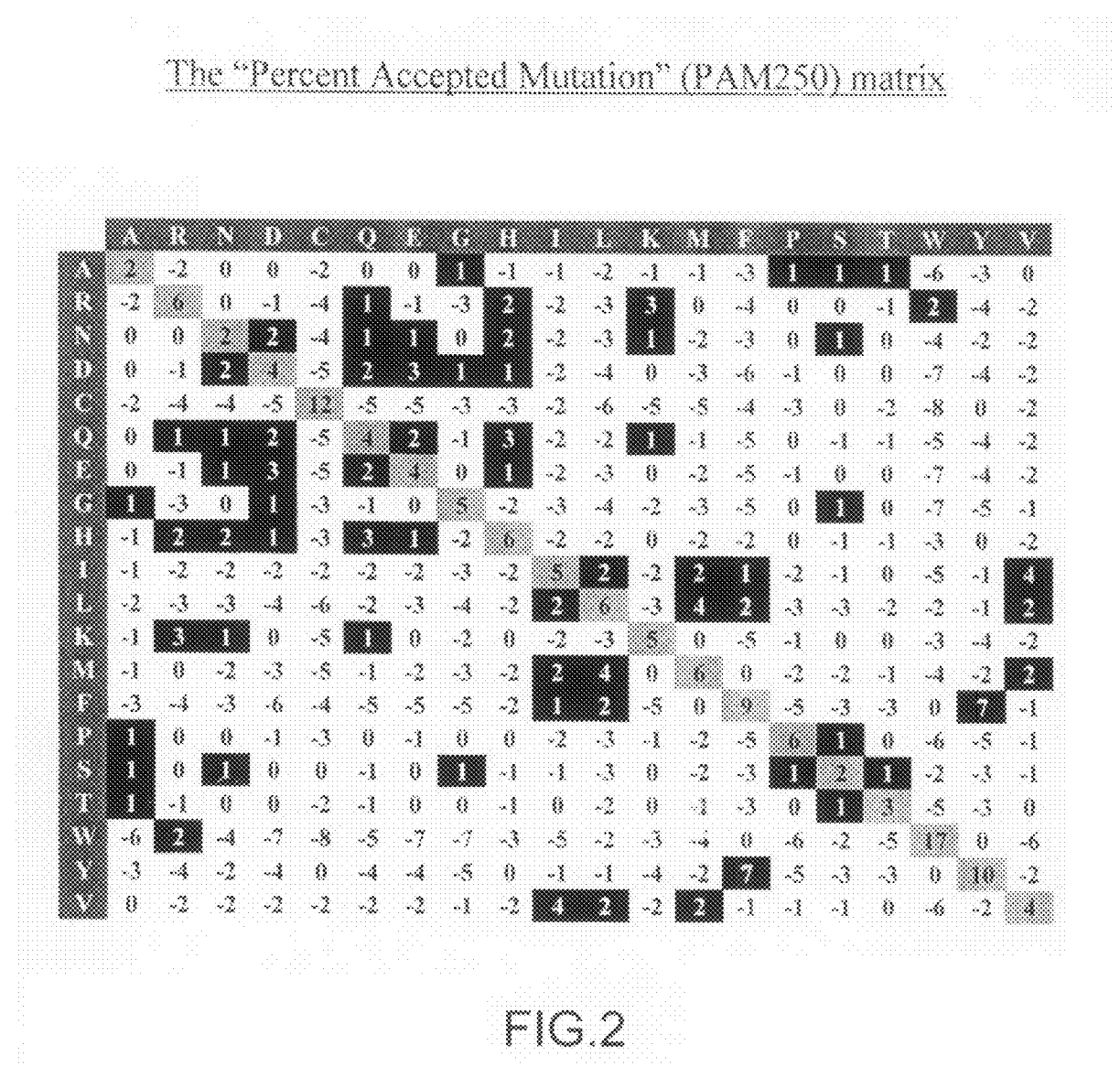

In a particular embodiment, the PAM250 matrix set forth in FIG. 2 is used for determining the replacing amino acids based on similarity criteria. The PAM250 matrix uses data obtained directly from natural evolution to facilitate the selection of replacing amino acids for the is-HITs to generate conservative mutations without much affecting the overall protein function. By using the PAM250 matrix, candidate replacing amino acids are identified from related proteins from different organisms.

b. Jones et al. and Gonnet et al.

This method (see, e.g., Jones et al., *Comput. Appl. Biosci.*, 8:275-282, 1992 and Gonnet et al., *Science*, 256:1433-1445, 1992) uses much of the same methodology as Dayhoff (see below), but with modern databases. The matrix of Jones et al., is extracted from Release 15.0 of the SWISS-PROT protein sequence database. Point mutations totaling 59,160 from 16,130 protein sequences were used to calculate a PAM250 (see below) matrix.

The matrix published by Gonnet et al., *Science*, 256:1433-1445, 1992, was built from a sequence database of 8,344,353 amino acid residues. Each sequence was compared against the entire database, such that $1.7 \times 10^6$ subsequent matches resulted for the significant alignments. These matches were then used to generate a matrix with a PAM distance of 250.

c. Fitch and Feng et al.

Fitch, *J. Mol. Evol.*, 16(1): 9-16, 1966, used an exchange matrix that contained for each pair (A, B) of amino acid types the minimum number of nucleotides that must be changed to encode amino acid A instead of amino acid B. Feng et al., *J. Mol. Evol.*, 21: 112-125, 1985, used an enhanced version of Fitch, *J. Mol. Evol.*, 16(1): 9-16, 1966, to build a Structure-Genetic matrix. In addition to considering the minimum number of base changes required to encode amino acid B instead of A, this method also considers the structural similarity of the amino acids.

d. McLachlan, Grantham and Miyata

McLachlan, *J. Mol. Biol.*, 61:409-424 1971, used 16 protein families, each with 2 to 14 members. The 89 sequences were aligned and the pairwise exchange frequency, observed in 9280 substitutions, was used to generate an exchange matrix with values varying from 0 to 9.

Grantham, *Science*, 185:862-864, 1974, considers composition, polarity and molecular volume of amino acid sidechains, properties that were highly correlated to the relative substitution frequencies tabulated by McLachlan, *J. Mol. Biol.*, 61:409-424, 1971, to build the matrix.

Miyata, *J. Mol. Evol.*, 12:219-236, 1979, uses the volume and polarity values of amino acids published by Grantham, *Science*, 185:862-864, 1974. For every amino acid type pair, the difference for both properties was calculated and divided by the standard deviation of all the differences. The square root of the sum of both values is then used in the matrix.

e. Rao

Rao, *J. Pept. Protein Res.*, 29:276-281, 1987, employs five amino acid properties to create a matrix; namely, alpha-helical, beta-strand and reverse-turn propensities as well as polarity and hydrophobicity. The standardized properties were summed and the matrix rescaled to the same average as that for PAM (Dayhoff et al., *Atlas of Protein Sequence and Structure*, 5(3):345-352, 1978).

f. Risler et al.

Risler et al., *J. Mol. Biol.*, 204:1019-1029, 1988, aligned 32 three-dimensional structures from 11 protein families by rigid-body superposition of the backbone topology. Only substitutions were considered where at least three adjacent and equivalent main-chain Cα atom pairs in the compared structures were each not more than 1.2 Å apart. A total of 2860 substitutions were considered and used to build a matrix based on $\chi^2$ distance calculations.

g. Johnson et al.

Johnson et al., *J. Mol. Biol.*, 233:716-738, 1993, derived their matrix from the tertiary structural alignment of 65 families in a database of 235 structures created with the method of Sali et al., *J. Mol. Biol.*, 212:403-428, 1990. Their examination of the substitutions was based on the expected and observed ratios of occurrences and the final matrix values were taken as log 10 of the ratios.

h. Block Substitution Matrix (BLOSUM)

One empirical approach (Henikoff et al., *Proc. Natl. Acad. Sci. USA*, 89:10915-10919, 1992) uses local, ungapped alignments of distantly related sequences to derive the blocks amino acid substitution matrix (BLOSUM) series of matrices. The matrix values are based on the observed amino acid substitutions in a larger set of about 2000 conserved amino acid patterns, termed blocks. These blocks act as signatures of families of related proteins. Matrices of this series are identified by a number after the matrix (e.g., BLOSUM50), which refers to the minimum percentage identity of the blocks of multiple aligned amino acids used to construct the matrix. It is noteworthy that these matrices are directly calculated without extrapolations, and are analogous to transition probability matrices P(T) for different values of T, estimated without reference to any rate matrix Q.

The outcome of these two steps set forth above, which is performed in silico is that: (1) the amino acid positions that will be the target for mutagenesis are identified; these positions are referred to as is-HITs; (2) the replacing amino acids for the original, such as native, amino acids at the is-HITs are identified, to provide a collection of candidate LEAD mutant molecules that are expected to perform different from the native one. These are assayed for a desired optimized (or improved or altered) biological activity.

3. Physical Construction of Mutant Proteins and Biological Assays

Once is-HITs are selected as set forth above, replacing amino acids are introduced. Mutant proteins typically are prepared using recombinant DNA methods and assessed in appropriate biological assays for the particular biological activity (feature) optimized (see, e.g., Example 1). An exemplary method of preparing the mutant proteins is by mutagenesis of the original, such as native, gene using methods well known in the art. Mutant molecules are generated one-by-one, such as in addressable arrays, such that each individual mutant generated is the single product of each single and independent mutagenesis reaction. Individual mutagenesis reactions are conducted separately, such as in addressable arrays where they are physically separated from each other. Once a population of sets of nucleic acid molecules encoding the respective mutant proteins is prepared, each is separately introduced one-by-one into appropriate cells for the production of the corresponding mutant proteins. This can also be performed, for example, in addressable arrays where each set of nucleic acid molecules encoding a respective mutant protein is introduced into cells confined to a discrete location, such as in a well of a multi-well microtiter plate. Each individual mutant protein is individually phenotypically characterized and performance is quantitatively assessed using assays appropriate for the feature being optimized (i.e., feature being evolved). Again, this step can be performed in addressable arrays. Those mutants displaying a desired increased or decreased performance compared to the original, such as native molecules are identified and designated LEADs. From the beginning of the process of generating the mutant DNA molecules up through the readout and analysis of the performance results, each candidate LEAD mutant is generated, produced and analyzed individually, such as from its own address in an addressable array. The process is amenable to automation.

D. 2-Dimensional Scanning Of Proteins For Increased Resistance to Proteolysis

The methods of 2-dimensional scanning permit preparation of proteins modified for a selected trait, activity or other phenotype. Among modifications of interest for therapeutic proteins are those that increase protection against protease digestion while maintaining the requisite biological activity. Such changes are useful for producing longer-lasting therapeutic proteins.

The delivery of stable peptide and protein drugs to patients is a major challenge for the pharmaceutical industry. These types of drugs in the human body are constantly eliminated or taken out of circulation by different physiological processes including internalization, glomerular filtration and proteolysis. The latter is often the limiting process affecting the half-life of proteins used as therapeutic agents in per-oral administration and either intravenous or intramuscular injections.

The 2-dimensional scanning process for protein evolution is used to effectively improve protein resistance to proteases and thus increase protein half-life in vitro and, ultimately in vivo. As noted, the methods provided herein for designing and generating highly stable, longer lasting proteins, or proteins having a longer half-life include: i) identifying some or all possible target sites on the protein sequence that are susceptible to digestion by one or more specific proteases (these sites are referred to herein as is-HITs); ii) identifying appropriate replacing amino acids, specific for each is-HIT, such that upon replacement of one or more of the original, such as native, amino acids at that specific is-HIT, they can be expected to increase the is-HIT's resistance to digestion by protease while at the same time, maintaining or improving the requisite biological activity of the protein (these proteins with replaced amino acids are the "candidate LEADs"); iii) systematically introducing the specific replacing amino acids (candidate LEADs) at every specific is-HIT target position to generate a collection containing the corresponding mutant candidate lead molecules. Mutants are generated, produced and phenotypically characterized one-by-one, such as in addressable arrays, such that each mutant molecule contains initially an amino acid replacement at only one is-HIT site.

In particular embodiments, such as in subsequent rounds, mutant molecules also can be generated that contain one or more amino acids at one or more is-HIT sites that have been replaced by candidate LEAD amino acids. Those mutant proteins carrying one or more mutations at one or more is-HITs, and that display improved protease resistance are called LEADs (one mutation at one is-HIT) and super-LEADs (mutations at more than one is-HIT).

The first step of the process takes into consideration existing knowledge from different domains:

(1) About the galenic and the delivery environment (tissue, organ or corporal fluid) of the particular therapeutic protein in order to establish a list of proteases more likely to be found in that environment. For example, a therapeutic protein in per-oral application is likely to encounter typical proteases of the luminal gastrointestinal tract. In contrast, if this protein were injected in the blood circulation, serum proteases would be implicated in the proteolysis. Based on the specific list of proteases involved, the complete list of all amino acid sequences that potentially could be targeted by the proteases in the list is determined.

(2) Since protease mixtures in the body are quite complex in composition, almost all the residues in any target protein potentially are targeted for proteolysis (FIG1A). Nevertheless, proteins form specific tri-dimensional structures where residues are more or less exposed to the environment and protease action. It can be assumed that those residues constituting the core of a protein are inaccessible to proteases, while those more "exposed" to the environment are better targets for proteases. The probability for every specific amino acid to be "exposed" and then to be accessible to proteases can be taken into account to reduce the number of is-HIT. Consequently, the methods herein consider the analysis with respect to solvent "exposure" or "accessibility" for each individual amino acid in the protein sequence. Solvent accessibility of residues can alternatively be estimated, regardless of any previous knowledge of specific protein structural data, by using an algorithm derived from empirical amino acid probabilities of accessibility, which is expressed in the following equation (Boger et al., *Reports of the Sixth International Congress in Immunology*, p. 250, 1986):

$$A(i) = \left[ \prod_{j=1}^{6} \_\delta\_{i+4-j} \right] * [0.62]^{-6}.$$

Briefly, these are fractional probabilities ($\delta\_(i)$) determined for an amino acid (i) found on the surface of a protein, which are based upon structural data from a set of several proteins. It is thus possible to calculate the solvent accessibility (A) of an amino acid (A(i)) at sequence position (i−2 to i+3), onto a sliding window of length equal to 6) that is within an average surface accessible to solvent of >20 square angstroms ($Å^2$).

The protease accessible target amino acids along the protein sequence, i.e., the amino acids to be replaced, are thus identified and are referred to herein as in silico HITs (is-HITs).

Amino acids at the is-HITs then are replaced by residues that render the sequence less vulnerable (by a factor, for example, of 1%, 10%, 20%, 30%, 40%, 50%, . . . 100% depending upon the protein) or invulnerable (substantially no detectable digestion within a set time period) to protease digestion, while at the same time maintain a biological activity or activities of interest of the protein. The choice of the replacing amino acids is complicated by (1) the broad target specificity of certain proteases and (2) the need to preserve the physicochemical properties such as hydrophobicity, charge and polarity, of essential (e.g., catalytic, binding and/or other activities depending upon the protein) residues. For use in the methods herein, the "Percent Accepted Mutation" values (PAM values; see, Dayhoff et al., *Atlas of Protein Sequence and Structure*, 5(3):345-352, 1978), FIG2) can be used as described herein. PAM values, originally developed to produce alignments between protein sequences, are available in the form of probability matrices, which reflect an evolutionary distance. Since, in a family of proteins or homologous (related) sequences, identical or similar amino acids (85% similarity) are shared, conservative substitutions for, or "allowed point mutations" of the corresponding amino acid residues can be determined throughout an aligned reference sequence. As noted, conservative substitutions of a residue in a reference sequence are those substitutions that are physically and functionally similar to the corresponding reference residues e.g., that have a similar size, shape, electric charge, chemical properties, including the ability to form bonds such as covalent and hydrogen bonds. For example, conservative substitutions can be those that exhibit the highest scores and fulfill the PAM matrix criteria in the form of "accepted point mutations."

By comparing a family of scoring matrices, Dayhoff et al., *Atlas of Protein Sequence and Structure*, 5(3):345-352, 1978), found consistently higher score significance when using PAM250 matrix to analyze a variety of proteins, known to be distantly related. For methods herein, the PAM250 matrix was selected for use. The PAM250 matrix is used, by learning directly from natural evolution, to find replacing amino acids for the is-HITs to generate conservative mutations without affecting the protein function. By using PAM250, candidate replacing amino acids are identified from related proteins from different organisms.

An exemplary class of proteins that can be optimized according to the methods provided herein are the cytokines. For example, 2D-scanning methods provided herein can be used to modify the following cytokines to increase their stability as assessed by an increased resistance to proteolysis resulting in an increased protein half-life in the bloodstream or any other desired biological activity of the selected protein. Exemplary cytokines, include, but are not limited to: interleukin-10 (IL-10; SEQ ID NO: 200), interferon beta (IFN-β; SEQ ID NO: 196), interferon alpha-2a (IFNα-2a; SEQ ID NO: 182), interferon alpha-2b (IFNα-2b; SEQ ID NO: 1), and interferon gamma (IFN-γ; SEQ ID NO: 199), granulocyte colony stimulating factor (G-CSF; SEQ ID NO: 210), leukemia inhibitory factor (LIF; SEQ ID NO: 213), growth hormone (hGH; SEQ ID NO: 216), ciliary neurotrophic factor (CNTF; SEQ ID NO: 212), leptin (SEQ ID NO: 211), oncostatin M (SEQ ID NO: 214), interleukin-6 (IL-6; SEQ ID NO: 217), interleukin-12 (IL-12; SEQ ID NO: 215), erythropoietin (EPO; SEQ ID NO: 201), granulocyte-macrophage colony stimulating factor (GM-CSF; SEQ ID NO: 202), interleukin-2 (IL-2; SEQ ID NO: 204), interleukin-3 (IL-3; SEQ ID NO: 205), interleukin-4 (IL-4; SEQ ID NO: 207), interleukin-5 (IL-5; SEQ ID NO: 208), interleukin-13 (IL-13; SEQ ID NO: 209), Flt3 ligand (SEQ ID NO: 203) and stem cell factor (SCF; SEQ ID NO: 206).

Accordingly, provided herein are modified cytokines that exhibit increased resistance to proteolysis compared to the unmodified cytokine. The modified cytokines can be selected from among a member of the interferons/interleukin-10 protein family, a member of the long-chain cytokine family; and a member of the short-chain cytokine family. In particular embodiments, the modified cytokines provided herein are selected from among: interleukin-10 (IL-10), interferon beta (IFNβ), interferon alpha-2a (IFNα-2a), interferon alpha-2b (IFNα-2b), and interferon gamma (IFN-γ), granulocyte colony stimulating factor (G-CSF), leukemia inhibitory factor (LIF), human growth hormone (hGH), ciliary neurotrophic factor (CNTF), leptin, oncostatin M, interleukin-6 (IL-6) and interleukin-12 (IL-12), erythropoietin (EPO), granulocyte-macrophage colony stimulating factor (GM-CSF), interleukin-2 (IL-2), interleukin-3 (IL-3), interleukin-4 (IL-4), interleukin-5 (IL-5), interleukin-13 (IL-13), Flt3 ligand and stem cell factor (SCF). In one embodiment, the modified cytokine is an interferon, including modified interferon α-2b (IFNα-2b).

E. Rational Evolution of IFNα-2b for Increased Resistance to Proteolysis

IFNα-2b is used for a variety of applications. Typically it is used for treatment of type B and C chronic hepatitis. Additional indications include, but are not limited to, melanomas, herpes infections, Kaposi sarcomas and some leukemia and lymphoma cases. Patients receiving interferon are subject to frequent repeat applications of the drug. Since such frequent injections generate uncomfortable physiological as well as undesirable psychological reactions in patients, increasing the half-life of interferons and thus decreasing the necessary frequency of interferon injections, would be extremely useful to the medical community. For example, after injection of native human IFNα-2b injection in mice, as a model system, its presence can be detected in the serum between 3 and 10 hours with a half-life of only around 4 hours. The IFNα-2b completely disappears to undetectable levels by 18-24 hours after injection. Provided herein are mutant variants of the IFNα-2b protein that display altered properties including: (a) highly improved stability as assessed by resistance to proteases in vitro and by pharmacokinetics studies in mice; and (b) at least comparable biological activity as assessed by antiviral and antiproliferative action compared to both the unmodified and wild type native IFNα-2b protein and to at least one pegylated derivative of the wild type native IFNα. As a result, the IFNα-2b mutant proteins provided herein confer a higher half-life and at least comparable antiviral and antiproliferation activity (sufficient for a therapeutic effect) with respect to the native sequence and to the pegylated derivatives molecules currently being used for the clinical treatment of hepatitis C infection. See FIGS. 6(A)-6(N), 6(T) and 6(U). Thus, the optimized IFNα-2b protein mutants that possess increased resistance to proteolysis and/or glomerular filtration provided herein result in a decrease in the frequency of injections needed to maintain a sufficient drug level in serum, leading to i) higher comfort and acceptance by patients, ii) lower doses necessary to achieve comparable biological effects, and iii) as a consequence of (ii), an attenuation of the (dose-dependent) secondary effects observed in humans.

In particular embodiments, the half-life of the IFNα-2b and IFNα-2a mutants provided herein is increased by an amount selected from at least 10%, at least 20%, at least 30%, at least 40%, at least 50%, at least 60%, at least 70%, at least 80%, at least 90%, at least 100%, at least 150%, at least 200%, at least 250%, at least 300%, at least 350%, at least 400%, at least 450%, at least 500% or more, when compared to the half-life of native human IFNα-2b and IFNα-2a in either human blood, human serum or an in vitro mixture containing one or more proteases. In other embodiments, the half-life of the IFNα-2b and IFNα-2a mutants provided herein is increased by an amount selected from at least 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more, when compared to the half-life of native human IFNα-2b and IFNα-2a in either human blood, human serum or an in vitro mixture containing one or more proteases.

Two methodologies were used herein to increase the stability of IFNα-2b by amino acid replacement: i) amino acid replacement that leads to higher resistance to proteases by direct destruction of the protease target residue or sequence, while either maintaining or improving the requisite biological activity (e.g., antiviral activity, antiproliferation activity), and/or ii) amino acid replacement that leads to a different pattern of N-glycosylation, thus decreasing both glomerular filtration and sensitivity to proteases, while either improving or maintaining the requisite biological activity (e.g., antiviral activity, antiproliferation activity).

The 2D-scanning methods provided herein were used to identify the amino acid changes on IFNα-2b that lead to an increase in stability when challenged either with proteases, human blood lysate or human serum. Increasing protein stability to proteases, human blood lysate or human serum, and/or increasing the molecular size is contemplated herein to provide a longer in vivo half-life for the particular protein molecules, and thus to a reduction in the frequency of necessary injections into patients. The biological activities that were measured for the IFNα-2b molecules are i) their capacity to inhibit virus replication when added to permissive cells previously infected with the appropriate virus, and ii) their capacity to stimulate cell proliferation when added to the appropriate cells. Prior to the measurement of biological activity, IFNα-2b molecules were challenged with proteases, human blood lysate or human serum during different incubation times. The biological activity measured, corresponds then to the residual biological activity following exposure to the protease-containing mixtures.

As set forth above, provided herein are methods for the development of IFNα-2b and IFNα-2a molecules that, while maintaining the requisite biological activity intact, have been rendered less susceptible to digestion by blood proteases and therefore display a longer half-life in blood circulation. In this particular example, the method used included the following specific steps as set forth in Example 2:

1) Identifying some or all possible target sites on the protein sequence that are susceptible to digestion by one or more specific proteases (these sites are the is-HITs) and 2) Identifying appropriate replacing amino acids, specific for each is-HIT, such that if used to replace one or more of the original amino acids at that specific is-HIT, they can be expected to increase the is-HIT's resistance to digestion by protease while at the same time, keeping the biological activity of the protein unchanged (these replacing amino acids are the "candidate LEADs").

As set forth in Example 2, the 3-dimensional structure of IFNα-2b obtained from the NMR structure of IFNα-2a (PDB code 1ITF) was used to select only those residues exposed to solvent from a list of residues along the IFNα-2b and IFNα-2a sequence which can be recognized as a substrate for different enzymes present in the serum. Residue 1 corresponds to the first residue of the mature peptide IFNα-2b (SEQ ID NO:1) encoded by nucleotides 580-1074 of sequence accession No. J00207. Using this approach, the following 42 amino acid target positions were identified as is-HITs on IFNα-2b or IFNα-2a, which numbering is that of the mature protein (SEQ ID NO:1 or SEQ ID NO:182, respectively): L3, P4, R12, R13, M16, R22, K23 or R23, F27, L30, K31, R33, E41, K49, E58, K70, E78, K83, Y89, E96, E107, P109, L110, M111, E113, L117, R120, K121, R125, L128, K131, E132, K133, K134, Y135, P137, M148, R149, E159, L161, R162, K164, and E165. Each of these positions was replaced by residues defined as compatible by the substitution matrix PAM250 while at the same time not generating any new substrates for proteases. For these 42 is-HITs, the residue substitutions determined by PAM250 analysis were as follows:

R to H, Q
E to H, Q
K to Q, T

L to V, I
M to I, V
P to A, S
Y to I, H.

1. Modified IFNα-2b Proteins with Single Amino Acid Substitutions (is-HITS)

Among the mutant proteins provided herein, are mutant IFNα-2b proteins that have increased resistance proteolysis compared to the unmodified, typically wild-type, protein. The mutant IFNα-2b proteins include those selected from among proteins containing more single amino acid replacements in SEQ ID NO:1, corresponding to: L by V at position 3; L by I at position 3; P by S at position 4; P by A at position 4; R by H at position 12; R by Q at position 12; R by H at position 13; R by Q at position 13; M by V at position 16; M by I at position 16; R by H at position 22; R by Q at position 22; R by H at position 23; R by Q at position 23; F by I at position 27; F by V at position 27; L by V at position 30; L by I at position 30; K by Q at position 31; K by T at position 31; R by H at position 33; R by Q at position 33; E by Q at position 41; E by H at position 41; K by Q at position 49; K by T at position 49; E by Q at position 58; E by H at position 58; K by Q at position 70; K by T at position 70; E by Q at position 78; E by H at position 78; K by Q at position 83; K by T at position 83; Y by H at position 89; Y by I at position 89; E by Q at position 96; E by H at position 96; E by Q at position 107; E by H at position 107; P by S at position 109; P by A at position 109; L by V at position 110; L by I at position 110; M by V at position 111; M by I at position 111; E by Q at position 113; E by H at position 113; L by V at position 117; L by I at position 117; R by H at position 120; R by Q at position 120; K by Q at position 121; K by T at position 121; R by H at position 125; R by Q at position 125; L by V at position 128; L by I at position 128; K by Q at position 131; K by T at position 131; E by Q at position 132; E by H at position 132; K by Q at position 133; K by T at position 133; K by Q at position 134; K by T at position 134; Y by H at position 135; Y by I at position 135; P by S at position 137; P by A at position 137; M by V at position 148; M by I at position 148; R by H at position 149; R by Q at position 149; E by Q at position 159; E by H at position 159; L by V at position 161; L by I at position 161; R by H at position 162; R by Q at position 162; K by Q at position 164; K by T at position 164; E by Q at position 165; and E by H at position 165.

2. LEAD Identification

Next the specific replacing amino acids (candidate LEADs) are systematically introduced at every specific is-HIT position to generate a collection containing the corresponding mutant IFNα-2b DNA molecules, as set forth in Example 2. The mutant DNA molecules were used to produce the corresponding mutant IFNα-2b protein molecules by transformation or transfection into the appropriate cells. These protein mutants were assayed for (i) protection against proteolysis, (ii) antiviral and antiproliferation activity in vitro, (iii) pharmacokinetics in mice. Of particular interest are mutations that increase these activities of the IFNα-2b mutant proteins compared to unmodified wild type IFNα-2b protein and to pegylated derivatives of the wild type protein. Based on the results obtained from these assays, each individual IFNα-2b variant was assigned a specific activity. Those variant proteins displaying the highest stability and/or resistance to proteolysis were selected as LEADs. The candidate LEADs that possessed at least as much residual antiviral activity following protease treatment as the control, native IFNα-2b, before protease treatment were selected as LEADs. The results are set forth in Table 2 of Example 2.

Using this method, the following mutants selected as LEADs are provided herein and correspond to the group of proteins containing one or more single amino acid replacements in SEQ ID NO: 1, corresponding to: F by V at position 27; R by H at position 33; E by Q at position 41; E by H at position 41; E by Q at position 58; E by H at position 58; E by Q at position 78; E by H at position 78; Y by H at position 89; E by Q at position 107; E by H at position 107; P by A at position 109; L by V at position 110; M by V at position 111; E by Q at position 113; E by H at position 113; L by V at position 117; L by I at position 117; K by Q at position 121; K by T at position 121; R by H at position 125; R by Q at position 125; K by Q at position 133; K by T at position 133; and E by Q at position 159; E by H at position 159. Among these are mutations that can have multiple effects. For example, among mutations described herein, are mutations that result in an increase of the IFNα-2b activity as assessed by detecting the requisite biological activity.

Also provided are IFNα-2b proteins that contain a plurality of mutations based on the LEADs (see, e.g., Tables 6 and 7, EXAMPLE 5, which lists candidate LEADs and LEAD sites), are generated. These IFNα-2b proteins have activity that is further optimized. Examples of such proteins are described in the EXAMPLES. Other combinations of mutations can be prepared and tested as described herein to identify other LEADs of interest, particularly those that have further increased IFNα-2b antiviral activity or further increased resistance to proteolysis.

Also provided herein are modified IFNα-2b or IFNα-2a cytokines selected from among proteins comprising one or more single amino acid replacements in SEQ ID NOS:1 or 182, corresponding to the replacement of: N by D at position 45; D by G at position 94; G by R at position 102; A by G at position 139; or any combination thereof. These particular proteins have also been found herein to have increased resistance to proteolysis.

In another embodiment, IFNα-2b and IFNα-2a proteins that contain a plurality of mutations based on the LEADs (see Tables in the EXAMPLES, listing the candidate LEADs and LEAD sites), are produced to produce IFNα-2b and IFNα-2a proteins that have activity that is further optimized. Examples of such proteins are described herein. Other combinations of mutations can be prepared and tested as described herein to identify other LEADs of interest, particularly those that have further increased IFNα-2b and IFNα-2a antiviral activity or further increased resistance to proteolysis.

3. N-glycosylation Site Addition

In additional embodiments, N-glycosylation sites can be added to increase resistance to proteolysis while maintaining or improving the requisite biological activity. Exemplary N-glycosylation mutants containing duo-amino acid replacements corresponding to the N—X—S or N—X—T consensus sequences are set forth in Example 3. Accordingly, provided herein are IFNα-2b and IFNα-2a mutant proteins having an increased resistance to proteolysis compared to unmodified IFNα-2b and IFNα-2a, selected from among proteins comprising one or more sets of duo-amino acid replacements in SEQ ID NO:1, corresponding to:
D by N at position 2 and P by S at position 4;
D by N at position 2 and P by T at position 4;
L by N at position 3 and Q by S at position 5;
L by N at position 3 and Q by T at position 5;
P by N at position 4 and T by S at position 6;
P by N at position 4 and T by T at position 6;
Q by N at position 5 and H by S at position 7;
Q by N at position 5 and H by T at position 7;
T by N at position 6 and S by S at position 8;

T by N at position 6 and S by T at position 8;
H by N at position 7 and L by S at position 9;
H by N at position 7 and L by T at position 9;
S by N at position 8 and G by S at position 10;
S by N at position 8 and G by T at position 10;
L by N at position 9 and S by S at position 11;
L by N at position 9 and S by T at position 11;
M by N at position 21 and K by S at position 23;
M by N at position 21 and K by T at position 23;
R by N at position 22 and I by S at position 24;
R by N at position 22 and I by T at position 24;
K or R by N at position 23 and S by S at position 25;
K or R by N at position 23 and S by T at position 25;
I by N at position 24 and L by S at position 26;
I by N at position 24 and L by T at position 26;
S by N at position 25 and F by S at position 27;
S by N at position 25 and F by T at position 27;
L by N at position 26 and S by S at position 28;
L by N at position 26 and S by T at position 28;
S by N at position 28 and L by S at position 30;
S by N at position 28 and L by T at position 30;
L by N at position 30 and D by S at position 32;
L by N at position 30 and D by T at position 32;
K by N at position 31 and R by S at position 33;
K by N at position 31 and R by T at position 33;
D by N at position 32 and H by S at position 34;
D by N at position 32 and H by T at position 34;
R by N at position 33 and D by S at position 35;
R by N at position 33 and D by T at position 35;
H by N at position 34 and F by S at position 36;
H by N at position 34 and F by T at position 36;
D by N at position 35 and G by S at position 37;
D by N at position 35 and G by T at position 37;
F by N at position 36 and F by S at position 38;
F by N at position 36 and F by T at position 38;
G by N at position 37 and P by S at position 39;
G by N at position 37 and P by T at position 39;
F by N at position 38 and Q by S at position 40;
F by N at position 38 and Q by T at position 40;
P by N at position 39 and E by S at position 41;
P by N at position 39 and E by T at position 41;
Q by N at position 40 and B by S at position 42;
Q by N at position 40 and E by T at position 42;
B by N at position 41 and F by S at position 43;
E by N at position 41 and F by T at position 43;
E by N at position 42 and G by S at position 44;
E by N at position 42 and G by T at position 44;
F by N at position 43 and N by S at position 45;
F by N at position 43 and N by T at position 45;
G by N at position 44 and Q by S at position 46;
G by N at position 44 and Q by T at position 46;
N by N at position 45 and F by S at position 47;
N by N at position 45 and F by T at position 47;
Q by N at position 46 and Q by S at position 48;
Q by N at position 46 and Q by T at position 48;
F by N at position 47 and K by S at position 49;
F by N at position 47 and K by T at position 49;
Q by N at position 48 and A by S at position 50;
Q by N at position 48 and A by T at position 50;
K by N at position 49 and E by S at position 51;
K by N at position 49 and E by T at position 51;
A by N at position 50 and T by S at position 52;
A by N at position 50 and T by T at position 52;
S by N at position 68 and K by S at position 70;
S by N at position 68 and K by T at position 70;
K by N at position 70 and S by S at position 72;
K by N at position 70 and S by T at position 72;
A by N at position 75 and D by S at position 77;
A by N at position 75 and D by T at position 77;
D by N at position 77 and T by S at position 79;
D by N at position 77 and T by T at position 79;
I by N at position 100 and G by S at position 102;
I by N at position 100 and G by T at position 102;
Q by N at position 101 and V by S at position 103;
Q by N at position 101 and V by T at position 103;
G by N at position 102 and G by S at position 104;
G by N at position 102 and G by T at position 104;
V by N at position 103 and V by S at position 105;
V by N at position 103 and V by T at position 105;
G by N at position 104 and T by S at position 106;
G by N at position 104 and T by T at position 106;
V by N at position 105 and E by S at position 107;
V by N at position 105 and E by T at position 107;
T by N at position 106 and T by S at position 108;
T by N at position 106 and T by T at position 108;
E by N at position 107 and P by S at position 109;
E by N at position 107 and P by T at position 109;
T by N at position 108 and I by S at position 110;
T by N at position 108 and I by T at position 110;
K by N at position 134 and S by S at position 136;
K by N at position 134 and S by T at position 136;
S by N at position 154 and N by S at position 156;
S by N at position 154 and N by T at position 156;
T by N at position 155 and L by S at position 157;
T by N at position 155 and L by T at position 157;
N by N at position 156 and Q by S at position 158;
N by N at position 156 and Q by T at position 158;
L by N at position 157 and E by S at position 159;
L by N at position 157 and E by T at position 159;
Q by N at position 158 and S by S at position 160;
Q by N at position 158 and S by T at position 160;
E by N at position 159 and L by S at position 161;
E by N at position 159 and L by T at position 161;
S by N at position 160 and R by S at position 162;
S by N at position 160 and R by T at position 162;
L by N at position 161 and S by S at position 163;
L by N at position 161 and S by T at position 163;
R by N at position 162 and K by S at position 164;
R by N at position 162 and K by T at position 164;
S by N at position 163 and E by S at position 165; and
S by N at position 163 and E by T at position 165,
where residue 1 corresponds to residue 1 of the mature IFNα-2b or IFNα-2a protein set forth in SEQ ID NO:1 or SEQ ID NO:182, respectively. In particular embodiments, the IFNα-2b or IFNα-2a mutant protein has increased resistance to proteolysis compared to unmodified IFNα-2b or IFNα-2a, and is selected from among proteins comprising one or more sets of duo-amino acid replacements in SEQ ID NO:1, corresponding to:
Q by N at position 5 and H by S at position 7;
P by N at position 39 and E by S at position 41;
P by N at position 39 and E by T at position 41;
Q by N at position 40 and E by S at position 42;
Q by N at position 40 and E by T at position 42;
E by N at position 41 and F by S at position 43;
E by N at position 41 and F by T at position 43;
F by N at position 43 and N by S at position 45;
G by N at position 44 and Q by T at position 46;
N by N at position 45 and F by S at position 47;
N by N at position 45 and F by T at position 47;
Q by N at position 46 and Q by S at position 48;
F by N at position 47 and K by S at position 49;
F by N at position 47 and K by T at position 49;
I by N at position 100 and G by S at position 102;

I by N at position 100 and G by T at position 102;
V by N at position 105 and E by S at position 107;
V by N at position 105 and E by T at position 107;
T by N at position 106 and T by S at position 108;
T by N at position 106 and T by T at position 108;
E by N at position 107 and P by S at position 109;
E by N at position 107 and P by T at position 109;
L by N at position 157 and E by S at position 159;
L by N at position 157 and E by T at position 159;
E by N at position 159 and L by S at position 161; and
E by N at position 159 and L by T at position 161.

F. Protein Redesign

Provided herein are methods for designing and generating new versions of native or modified cytokines, such as IFNα-2b and IFNα-2a. Using these methods, the redesigned cytokine maintains either sufficient, typically equal or improved levels of a selected phenotype, such as a biological activity, of the original protein, while at the same time its amino acid sequence is changed by replacement of up to: at least 1%, at least 2%, at least 3%, at least 4%, at least 5%, at least 6%, at least 7%, at least 8%, at least 9%, at least 10%, at least 12%, at least 14%, at least 16%, at least 18%, at least 20%, at least 30%, at least 40% up to 50% or more of its native amino acids by the appropriate pseudo-wild type amino acids. Pseudo-wild type amino acids are those amino acids such that when they replace an original, such as native, amino acid at a given position on the protein sequence, the resulting protein displays substantially the same levels of biological activity (or sufficient activity for its therapeutic or other use) compared to the original, such as native, protein. In other embodiments, pseudo-wild type amino acids are those amino acids such that when they replace an original, such as native, amino acid at a given position on the protein sequence, the resulting protein displays the same phenotype, such as levels of biological activity, compared to an original, typically a native, protein. Pseudo-wild type amino acids and the appropriate replacing positions can be detected and identified by any analytical or predictive means; such as for example, by performing an alanine-scanning. Any other amino acid, particularly another amino acid that has a neutral effect on structure, such as Gly or Ser, also can be used for the scan. All those replacements of original, such as native, amino acids by Ala that do not lead to the generation of a HIT (a protein that has lost the desired biological activity), have either led to the generation of a LEAD (a protein with increased biological activity); or the replacement by Ala will be a neutral replacement, i.e., the resulting protein will display comparable levels of biological activity compared to the original, such as native, protein. The methods provided herein for protein redesign of cytokines, such as IFNα-2b and IFNα-2a, are intended to design and generate "artificial" (versus naturally existing) proteins, such that they consist of amino acid sequences not existing in nature, but that display biological activities characteristic of the original, such as native, protein. These redesigned proteins are contemplated herein to be useful for avoiding potential side effects that might otherwise exist in other forms of cytokines in treatment of disease. Other uses of redesigned proteins provided herein are to establish cross-talk between pathways triggered by different proteins; to facilitate structural biology by generating mutants that can be crystallized while maintaining activity; and to destroy an activity of a protein without changing a second activity or multiple additional activities.

In one embodiment, a method for obtaining redesigned proteins includes i) identifying some or all possible target sites on the protein sequence that are susceptible to amino acid replacement without losing protein activity (protein activity in a largest sense of the term enzymatic, binding, hormone, etc.) (These sites are the pseudo-wild type, ψ-wt sites); ii) identifying appropriate replacing amino acids (ψ-wt amino acids), specific for each ψ-wt site, such that if used to replace the native amino acids at that specific ψ-wt site, they can be expected to generate a protein with comparable biological activity compared to the original, such as native, protein, thus keeping the biological activity of the protein substantially unchanged; iii) systematically introducing the specific ψ-wt amino acids at every specific ψ-wt position so as to generate a collection containing the corresponding mutant molecules. Mutants are generated, produced and phenotypically characterized one-by-one, in addressable arrays, such that each mutant molecule contains initially amino acid replacements at only one ψ-wt site. In subsequent rounds mutant molecules also can be generated such that they contain one or more ψ-wt amino acids at one or more ψ-wt sites. Those mutant proteins carrying several mutations at a number of ψ-wt sites, and that display comparable or improved biological activity are called redesigned proteins or ψ-wt proteins. In particular embodiments, at least 1%, at least 2%, at least 3%, at least 4%, at least 5%, at least 6%, at least 7%, at least 8%, at least 9%, at least 10%, at least 15%, at least 20%, at least 25%, or more of the amino acid residue positions on a particular cytokine, such as IFNα-2b and IFNα-2a are replaced with an appropriate pseudo-wild type amino acid.

The first step is an amino acid scan over the full length of the protein. At this step, each and every one of the amino acids in the protein sequence is replaced by a selected reference amino acid, such as alanine. This permits the identification of "redesign-HIT" positions, i.e., positions that are sensitive to amino acid replacement. All of the other positions that are not redesign-HIT positions (i.e., those at which the replacement of the original, such as native, amino acid by the replacing amino acid, for example Ala, does not lead to a drop in protein fitness or biological activity) are referred to herein as "pseudo-wild type" positions. When the replacing amino acid, for example Ala, replaces the original, such as native, amino acid at a non-HIT position, then the replacement is neutral, in terms of protein activity, and the replacing amino acid is said to be a pseudo-wild type amino acid at that position. Pseudo-wild type positions appear to be less sensitive than redesign-HIT positions since they tolerate the amino acid replacement without affecting the protein activity that is being either maintained or improved. Amino acid replacement at the pseudo-wild type positions, result in a non-change in the protein fitness (e.g., possess substantially the same biological activity), while at the same time to a divergence in the resulting protein sequence compared to the original, such as native, sequence.

To first identify those amino acid positions on the IFNα-2b and IFNα-2a protein that are involved or not involved in IFNα-2b and IFNα-2a protein activity, such as binding activity of IFNα-2b and IFNα-2a to its receptor, an Ala-scan was performed on the IFNα-2b sequence as set forth in Example 4. For this purpose, each amino acid in the IFNα-2b protein sequence was individually changed to Alanine. Any other amino acid, particularly another amino acid that has a neutral effect on structure, such as Gly or Ser, also can be used. Each resulting mutant IFNα-2b protein was then expressed and the activity of the interferon molecule was then assayed. These particular amino acid positions, referred to herein as HITs would in principle not be suitable targets for amino acid replacement to increase protein stability, because of their involvement in the recognition of IFN-receptor or in the downstream pathways involved in IFN activity. For the Ala-scanning, the biological activity measured for the IFNα-2b molecules was: i) their capacity to inhibit virus replication when added to permissive cells previously infected with the appropriate virus and, ii) their capacity to stimulate cell proliferation when added to the appropriate cells. The relative activity of each individual mutant compared to the native protein is indicated in FIG. 10A through C. HITs are those mutants that produce a decrease in the activity of the protein (in the example: all the mutants with activities below about 30% of the native activity.

In addition, the alanine-scan was used to identify the amino acid residues on IFNα-2b that when replaced with alanine correspond to "pseudo-wild type" activity, i.e., those that can be replaced by alanine without leading to a decrease in biological activity. Knowledge of these amino acids is useful for the re-design of the IFNα-2b and IFNα-2a proteins. The results are set forth in Table 5, and include pseudo-wild type amino acid positions of IFNα-2b corresponding to SEQ ID NO:1, amino acid residues: 9, 10, 17, 20, 24, 25, 35, 37, 41, 52, 54, 56, 57, 58, 60, 63, 64, 65, 76, 89, and 90.

Accordingly, provided herein are IFNα-2b and IFNα-2a mutant proteins comprising one or more pseudo-wild type mutations at amino acid positions of IFNα-2b or IFNα-2a corresponding to SEQ ID NO:1 or SEQ ID NO:182, respectively, amino acid residues: 9, 10, 17, 20, 24, 25, 35, 37, 41, 52, 54, 56, 57, 58, 60, 63, 64, 65, 76, 89, and 90. The mutations can be either one or more of insertions, deletions and/or replacements of the native amino acid residue(s). In one embodiment, the pseudo-wild type replacements are mutations with alanine at each position. In another embodiment, the pseudo-wild type replacements are one or more mutations in SEQ ID NO:1 corresponding to:

L by A at position 9, L by A at position 17,
Q by A at position 20, I by A at position 24,
S by A at position 25, D by A at position 35,
G by A at position 37, E by A at position 41,
T by A at position 52, P by A at position 54,
L by A at position 56, H by A at position 57,
E by A at position 58, I by A at position 60,
I by A at position 63, F by A at position 64,
N by A at position 65, W by A at position 76,
Y by A at position 89, and Q by A at position 90.

In addition, the IFNα-2b alanine scan revealed the following redesign-HITs having decreased antiviral activity at amino acid positions of IFNα-2b corresponding to SEQ ID NO:1, amino acid residues: 2, 7, 8, 11, 13, 15, 16, 23, 26, 28, 29, 30, 31, 32, 33, 53, 69, 91, 93, 98, and 101. Accordingly, in particular embodiments where it is desired to decrease the anti-viral activity of IFNα-2b or IFNα-2a, either one or more of insertions, deletions and/or replacements of the native amino acid residue(s) can be carried out at one or more of amino acid positions of IFNα-2b or IFNα-2a corresponding to SEQ ID NO:1, amino acid residues: 2, 7, 8, 11, 13, 15, 16, 23, 26, 28, 29, 30, 31, 32, 33, 53, 69, 91, 93, 98, and 101.

Each of the redesign mutations set forth above can be combined with one or more of the IFNα-2b or IFNα-2a candidate LEAD mutations or one or more of the IFNα-2b or IFNα-2a LEAD mutants provided herein.

G. 3D-Scanning and Its Use for Modifying Cytokines

Also provided herein is a method of structural homology analysis for comparing proteins regardless of their underlying amino acid sequences. For a subset of proteins families, such as the family of human cytokines, this information is rationally exploited to produce modified proteins. This method of structural homology analysis can be applied to proteins that are evolved by any method, including the 2D scanning method described herein. When used with the 2D method in which a particular phenotype, activity or characteristic of a protein is modified by 2D analysis, the method is referred to as 3D-scanning.

The use of "structural homology" analysis in combination with the directed evolution methods provided herein provides a powerful technique for identifying and producing various new protein mutants, such as cytokines, having desired biological activities, such as increased resistance to proteolysis. For example, the analysis of the "structural homology" between an optimized mutant version of a given protein and "structurally homologous" proteins allows identification of the corresponding structurally related or structurally similar amino acid positions (also referred to herein as "structurally homologous loci") on other proteins. This permits identification of mutant versions of the latter that have a desired optimized feature(s) (biological activity, phenotype) in a simple, rapid and predictive manner (regardless of amino acid sequence and sequence homology). Once a mutant version of a protein is developed, then, by applying the rules of structural homology, the corresponding structurally related amino acid positions (and replacing amino acids) on other "structurally homologous" proteins readily are identified, thus allowing a rapid and predictive discovery of the appropriate mutant versions for the new proteins.

3-dimensionally structurally equivalent or similar amino acid positions that are located on two or more different protein sequences that share a certain degree of structural homology, have comparable functional tasks (activities and phenotypes). These two amino acids that occupy substantially equivalent 3-dimensional structural space within their respective proteins than can be said to be "structurally similar" or "structurally related" with each other, even if their precise positions on the amino acid sequences, when these sequences are aligned, do not match with each other. The two amino acids also are said to occupy "structurally homologous loci." "Structural homology" does not take into account the underlying amino acid sequence and solely compares 3-dimensional structures of proteins. Thus, two proteins can be said to have some degree of structural homology whenever they share conformational regions or domains showing comparable structures or shapes with 3-dimensional overlapping in space. Two proteins can be said to have a higher degree of structural homology whenever they share a higher amount of conformational regions or domains showing comparable structures or shapes with 3-dimensional overlapping in space. Amino acids positions on one or more proteins that are "structurally homologous" can be relatively far way from each other in the protein sequences, when these sequences are aligned following the rules of primary sequence homology. Thus, when two or more protein backbones are determined to be structurally homologous, the amino acid residues that are coincident upon three-dimensional structural superposition are referred to as "structurally similar" or "structurally related" amino acid residues in structurally homologous proteins (also referred to as "structurally homologous loci"). Structurally similar amino acid residues are located in substantially equivalent spatial positions in structurally homologous proteins.

For example, for proteins of average size (approximately 180 residues), two structures with a similar fold will usually display rms deviations not exceeding 3 to 4 angstroms. For example, structurally similar or structurally related amino acid residues can have backbone positions less than 3.5, 3.0, 2.5, 2.0, 1.7 or 1.5 angstrom from each other upon protein superposition. RMS deviation calculations and protein superposition can be carried out using any of a number of methods known in the art. For example, protein superposition and RMS deviation calculations can be carried out using all peptide backbone atoms (e.g., N, C, C(C═O), O and CA (when present)). As another example, protein superposition can be carried out using just one or any combination of peptide backbone atoms, such as, for example, N, C, C(C═O), O and CA (when present). In addition, one skilled in the art will recognize that protein superposition and RMS deviation calculations generally can be performed on only a subset of the entire protein structure. For example, if the protein superposition is carried out using one protein that has many more amino acid residues than another protein, protein superposition can be carried out on the subset (e.g., a domain) of the larger protein that adopts a structure similar to the smaller protein. Similarly, only portions of other proteins can be suitable for superimposition. For example, if the position of the C-terminal residues from two structurally homologous proteins differ significantly, the C-terminal residues can be omitted from the structural superposition or RMS deviation calculations.

Accordingly, provided herein are methods of rational evolution of proteins based on the identification of potential target sites for mutagenesis (is-HITs) through comparison of patterns of protein backbone folding between structurally related proteins, irrespective of the underlying sequences of the compared proteins. Once the structurally related amino acid positions are identified on the new protein, then suitable amino acid replacement criteria, such as PAM analysis, can be employed to identify candidate LEADs for construction and screening as described herein.

For example, analysis of "structural homology" between and among a number of related cytokines was used to identify on various members of the cytokine family, other than interferon alpha, those amino acid positions and residues that are structurally similar or structurally related to those found in the IFNα-2b mutants provided herein that have been optimized for improved stability. The resulting modified cytokines are provided. This method can be applied to any desired phenotype using any protein, such as a cytokine, as the starting material to which an evolution procedure, such as the rational directed evolution procedure of U.S. application Ser. No. 10/022,249 or the 2-dimensional scanning method provided herein, is applied. The structurally corresponding residues are then altered on members of the family to produce additional cytokines with similar phenotypic alterations.

1. Homology

Typically, homology between proteins is compared at the level of their amino acid sequences, based on the percent or level of coincidence of individual amino acids, amino acid per amino acid, when sequences are aligned starting from a reference, generally the residue encoded by the start codon. For example, two proteins are said to be "homologous" or to bear some degree of homology whenever their respective amino acid sequences show a certain degree of matching upon alignment comparison. Comparative molecular biology is primarily based on this approach. From the degree of homology or coincidence between amino acid sequences, conclusions can be made on the evolutionary distance between or among two or more protein sequences and biological systems.

The concept of "convergent evolution" is applied to describe the phenomena by which phylogenetically unrelated organisms or biological systems have evolved to share features related to their anatomy, physiology and structure as a response to common forces, constraints, and evolutionary demands from the surrounding environment and living organisms. Alternatively, "divergent evolution," is applied to describe the phenomena by which strongly phylogenetically related organisms or biological systems have evolved to diverge from identity or similarity as a response to divergent forces, constraints, and evolutionary demands from the surrounding environment and living organisms.

In the typical traditional analysis of homologous proteins there are two conceptual biases corresponding to: i) "convergent evolution," and ii) "divergent evolution." Whenever the aligned amino acid sequences of two proteins do not match well with each other, these proteins are considered "not related" or "less related" with each other and have different phylogenetic origins. There is no (or low) homology between these proteins and their respective genes are not homologous (or show little homology). If these two "non-homologous" proteins under study share some common functional features (e.g., interaction with other specific molecules, activity), they are determined to have arisen by "convergent evolution," i.e., by evolution of their non-homologous amino acid sequences, in such a way that they end up generating functionally "related" structures.

On the other hand, whenever the aligned amino acid sequences of two proteins do match with each other to a certain degree, these proteins are considered to be "related" and to share a common phylogenetic origin. A given degree of homology is assigned between these two proteins and their respective genes likewise share a corresponding degree of homology. During the evolution of their initial highly homologous amino acid sequence, enough changes can be accumulated in such a way that they end up generating "less-related" sequences and less related function. The divergence from perfect matching between these two "homologous" proteins under study is said come from "divergent evolution."

2. 3D-Scanning (Structural Homology) Methods

Structural homology refers to homology between the topology and three-dimensional structure of two proteins. Structural homology is not necessarily related to "convergent evolution" or to "divergent evolution," nor is it related to the underlying amino acid sequence. Rather, structural homology is likely driven (through natural evolution) by the need of a protein to fit specific conformational demands imposed by its environment. Particular structurally homologous "spots" or "loci" would not be allowed to structurally diverge from the original structure, even when its own underlying sequence does diverge. This structural homology is exploited herein to identify loci for mutation.

Within the amino acid sequence of a protein resides the appropriate biochemical and structural signals to achieve a specific spatial folding in either an independent or a chaperon-assisted manner. Indeed, this specific spatial folding ultimately determines protein traits and activity. Proteins interact with other proteins and molecules in general through their specific topologies and spatial conformations. In principle, these interactions are not based solely on the precise amino acid sequence underlying the involved topology or conformation. If protein traits, activity (behavior and phenotypes) and interactions rely on protein topology and conformation, then evolutionary forces and constraints acting on proteins can be expected to act on topology and conformation. Proteins sharing similar functions will share comparable characteristics in their topology and conformation, despite the underlying amino acid sequences that create those topologies and conformations.

3. Application of the 3D-Scanning Methods to Cytokines

The method based on structural homology, including the 3D-scanning method provided herein can be applied to any related proteins. For exemplary purposes herein it is applied to cytokines. In exemplary embodiments, methods for altering phenotypes of members of families of cytokines by altering one member such as by employing the 2-dimensional rational scanning method are provided. As provided herein, other members of these cytokine families then can be similarly modified by identifying and changing structurally homologous residues to similarly alter the phenotypes of such proteins.

In an exemplary embodiment herein, IFNα-2b mutants with increased resistance to proteolysis are generated by the 2-dimensional rational scanning method; IFNβ mutants also were generated. The corresponding residues on members of cytokine families that possess structural homology to IFNα-2b were identified and the identified residues on the other cytokines were similarly modified to produce cytokines with increased resistance to proteolysis. Hence also provided herein are cytokine mutants that display increased resistance to proteolysis and/or glomerular filtration containing one or more amino acid replacements.

Provided herein are mutant (modified) cytokines that display altered features and properties, such as a resistance to proteolysis. Methods for producing such modified cytokines also are provided.

Also provided herein is a method of structural homology analysis for comparing proteins regardless their underlying amino acid sequences. For a subset of proteins families, such as the family of human cytokines, this information is rationally exploited herein. Human cytokines all share a common helix bundle fold, which is used to structurally define the 4-helical cytokine superfamily in the structural classification of the protein database SCOP© (Structural Classification of Proteins; see, e.g., Murzin et al., *J. Mol. Biol.*, 247:536-540, 1995 and "scop.mrc-lmb.cam.ac.uk/scop/"). This superfamily includes three different families: 1) the interferons/interleukin-10 protein family (SEQ ID NOS: 1 and 182-200); 2) the long-chain cytokine family (SEQ ID NOS: 210-217); and 3) the short-chain cytokine family (SEQ ID NOS: 201-209).

For example, a distinct feature of cytokines from the interferons/interleukin-10 family is an additional (fifth) helix. This family includes interleukin-10 (IL-10; SEQ ID NO:200, interferon beta (IFNβ; SEQ ID NO: 196), interferon alpha-2a (IFNα-2a; SEQ ID NO: 182), interferon alpha-2b (IFNα-2b; SEQ ID NO:1), and interferon gamma (IFN-γ; SEQ ID NO: 199). The long-chain cytokine protein family includes, among others, granulocyte colony stimulating factor (G-CSF; SEQ ID NO: 210), leukemia inhibitory factor (LIF; SEQ ID NO: 213), growth hormone (hGH; SEQ ID NO: 216), ciliary neurotrophic factor (CNTF; SEQ ID NO: 212), leptin (SEQ ID NO: 211), oncostatin M (SEQ ID NO: 214), interleukin-6 (IL-6; SEQ ID NO: 217) and interleukin-12 (IL-12; SEQ ID NO: 215). The short-chain cytokine protein family includes, among others, erythropoietin (EPO; SEQ ID NO: 201), granulocyte-macrophage colony stimulating factor (GM-CSF; SEQ ID NO: 202), interleukin-2 (IL-2; SEQ ID NO: 204), interleukin-3 (IL-3; SEQ ID NO: 205), interleukin-4 (IL-4; SEQ ID NO: 207), interleukin-5 (IL-5; SEQ ID NO: 208), interleukin-13 (IL-13; SEQ ID NO: 209), Flt3 ligand (SEQ ID NO: 203) and stem cell factor (SCF; SEQ ID NO: 206).

Figure 8A:
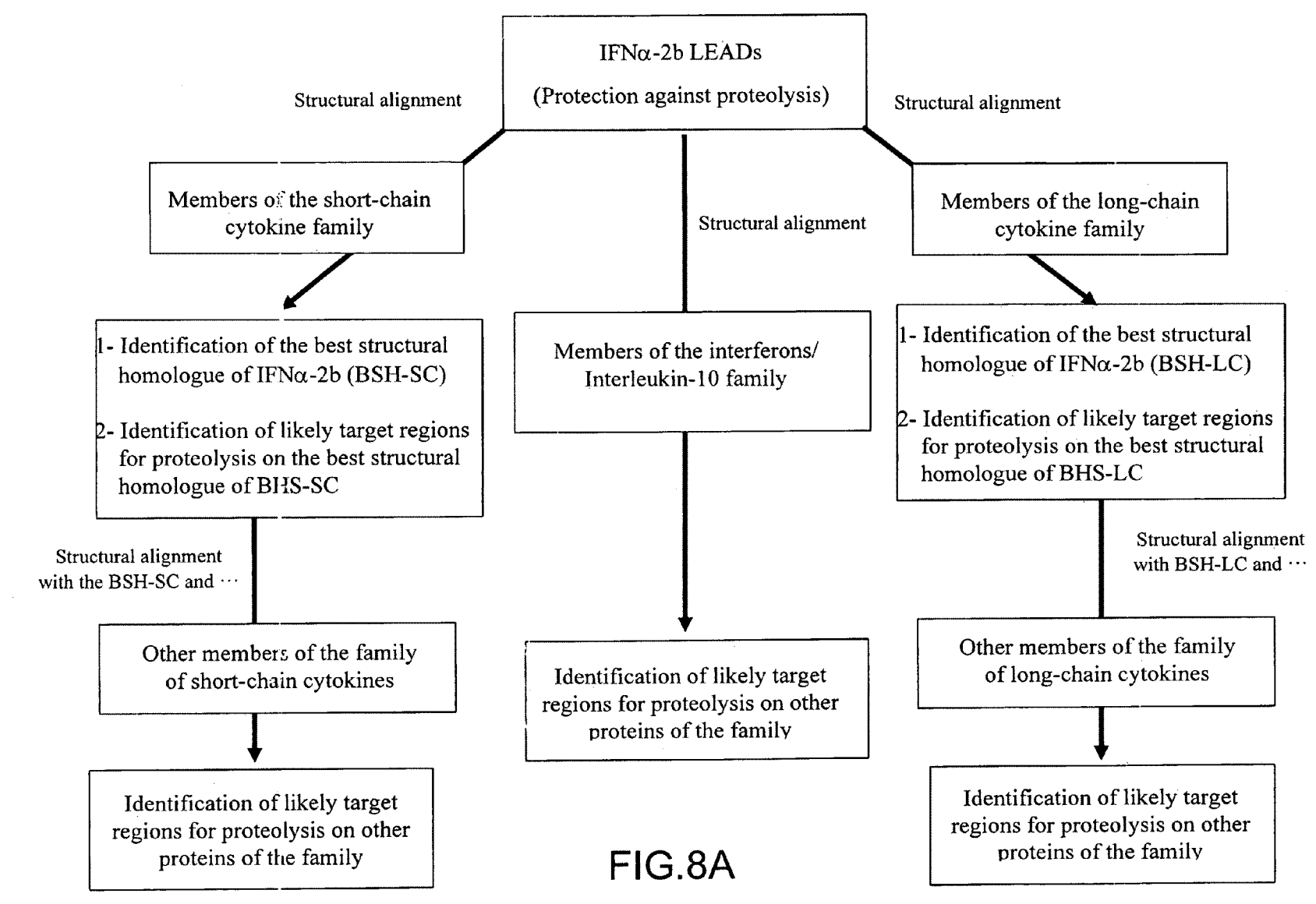
Figure 8B:
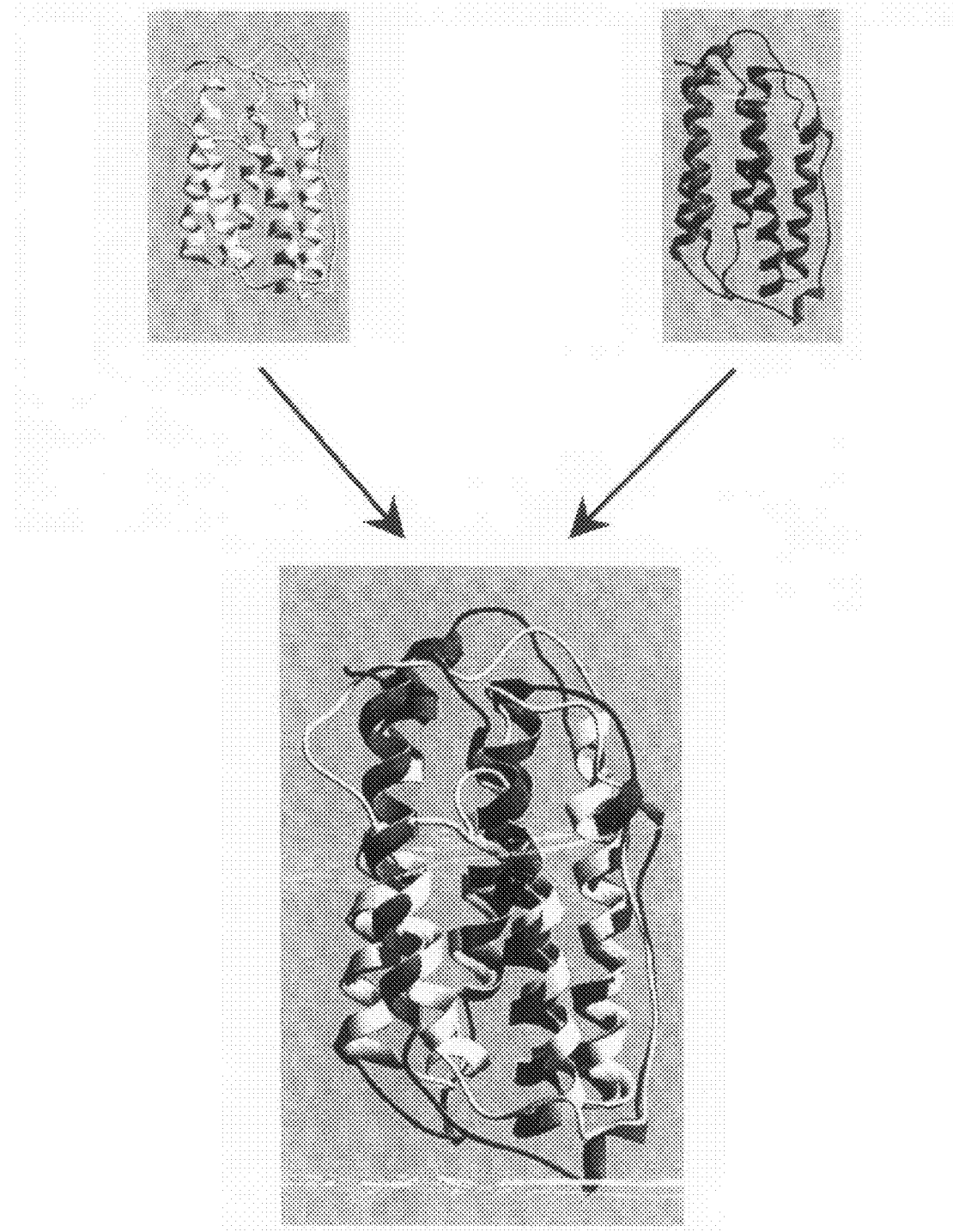
FIG. 8(B) illustrates a structural overlapping between human interferon α-2b obtained from the NMR structure of IFNα-2a (PDB code 1 ITF) and human interferon β (PDB code 1AU1) using Swiss PDB Viewer.
Figure 8C:
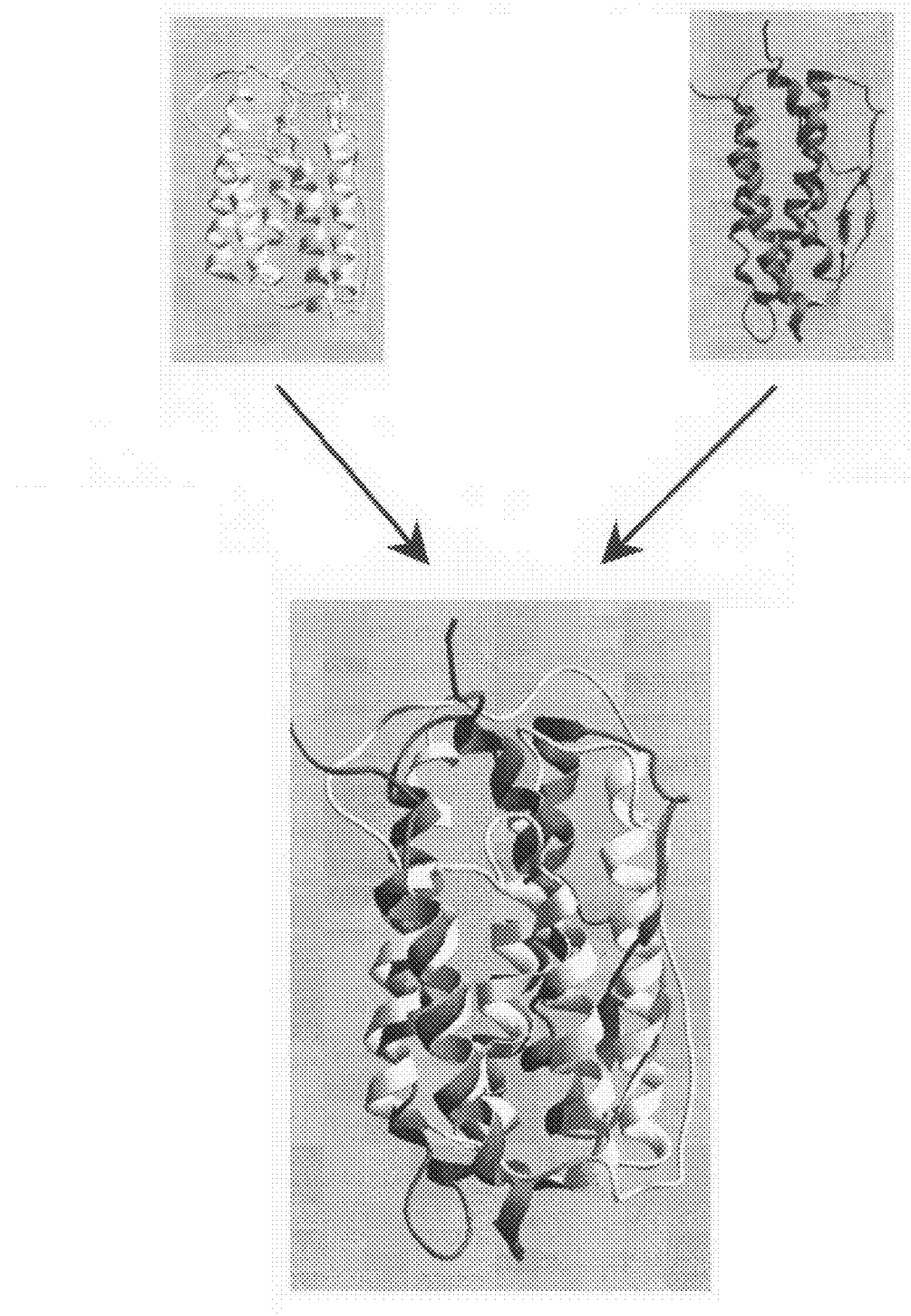
FIG. 8(C) illustrates a structural overlapping between human interferon α-2b obtained from the NMR structure of IFNα-2a (PDB code 1ITF) and erythropoietin (PDB code 1BUY) using Swiss PDB Viewer.
Figure 8D:
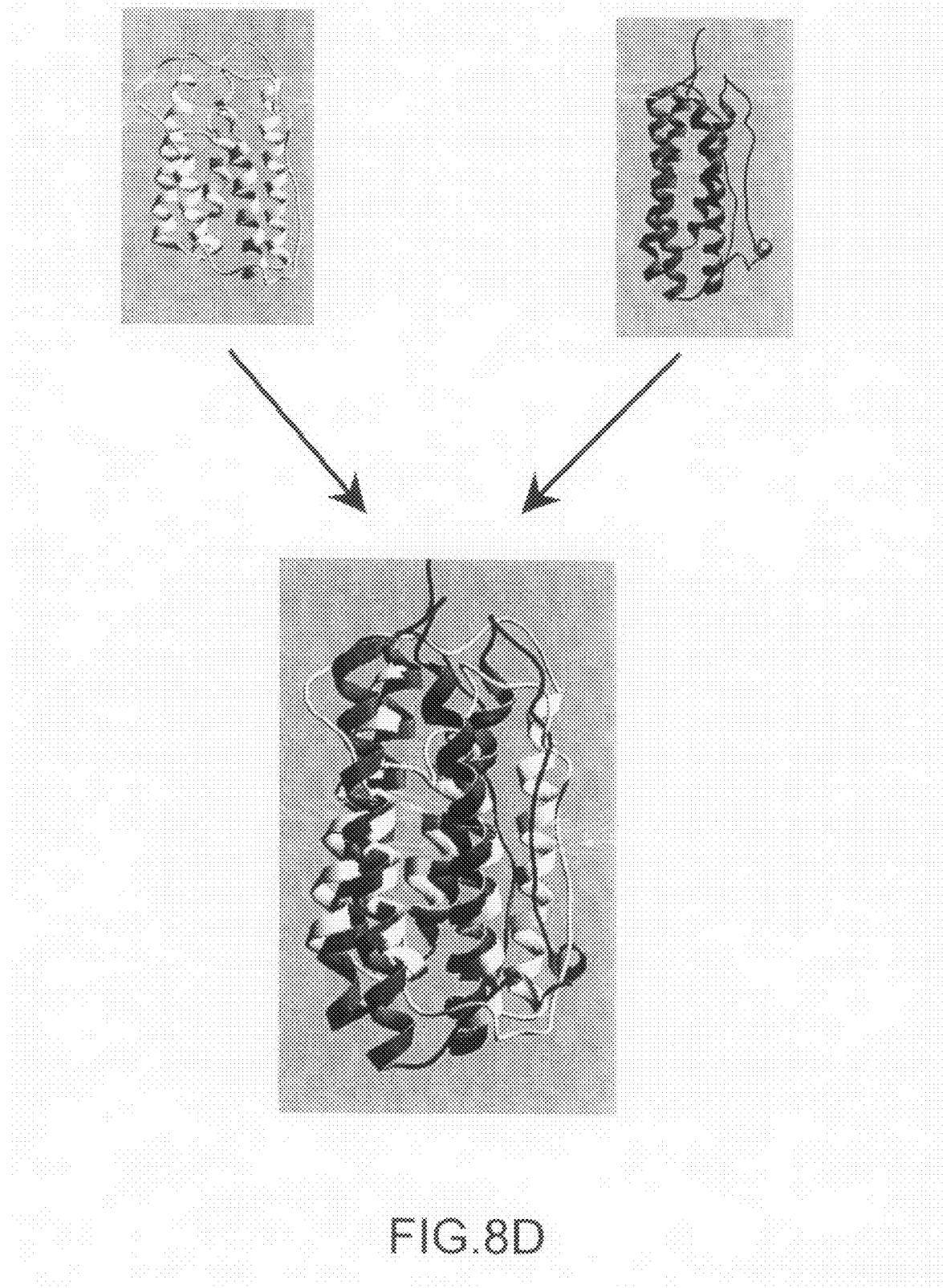
FIG. 8(D) illustrates a structural overlapping between human interferon α-2b obtained from the NMR structure of IFNα-2a (PDB code 1ITF) and granulocyte-colony stimulating factor (PDB code 1CD9) using Swiss PDB Viewer.

Although the degree of similarity among the underlying amino acid sequences of these cytokines does not appear high, their corresponding 3-dimensional structures present a high level of similarity (see, e.g., FIGS. 8B through D). Effectively, the best structural similarity is obtained between two 3-dimensional protein structures of the same family in the 4-helical cytokine superfamily.

The methods provided herein for producing mutant cytokines are exemplified with reference to production of cytokines that display a substantially equivalent increase in resistance to proteolysis relative to the optimized IFNα-2b mutants. It is understood that this method can be applied to other families of proteins and for other phenotypes.

In one embodiment, proteins of the 4-helical cytokine superfamily are provided herein that are structurally homologous IFNα-2b LEAD mutants set forth herein. For example, by virtue of the knowledge of the 3-dimensional structural amino acid positions within the LEAD IFNα-2b mutants provided herein that confer higher resistance to a challenge with either proteases or blood lysate or serum, while maintaining or improving the requisite biological activity, the corresponding structurally related (e.g., structurally similar) amino acid residues on a variety of other cytokines are identified (FIG. 9).

Numerous methods are well known in the art for identifying structurally related amino acid positions with 3-dimensionally structurally homologous proteins. Exemplary methods include, but are not limited to: CATH (Class, Architecture, Topology and Homologous superfamily) which is a hierarchical classification of protein domain structures based on four different levels (Orengo et al., *Structure*, 5(8): 1093-1108 (1997)); CE (Combinatorial Extension of the optimal path), which is a method that calculates pairwise structure alignments (Shindyalov et al., *Protein Engineering*, 11(9):739-747 (1998)); FSSP (Fold classification based on Structure-Structure alignment of Proteins), which is a database based on the complete comparison of all 3-dimensional protein structures that currently reside in the Protein Data Bank (PDB) (Holm et al., *Science*, 273:595-602 (1996)); SCOP® (Structural Classification of Proteins), which provides a descriptive database based on the structural and evolutionary relationships between all proteins whose structure is known (Murzin et al., *J. Mol. Biol.*, 247:536-540 (1995)); and VAST (Vector Alignment Search Tool), which compares newly determined 3-dimensional protein structure coordinates to those found in the MMDB/PDB database (Gibrat et al., *Current Opinion in Structural Biology*, 6:377-385 (1995)).

In an exemplary embodiment, the step-by-step process including the use of a program referred to as TOP (see FIG. 8A and Lu, G., *J. Appl. Cryst.*, 33:176-189 (2000)); publicly available, for example, at bioinfol.mbfys.lu.se/TOP is used for protein structure comparison. This program runs two steps for each protein structure comparison. In the first step topology of secondary structure in the two structures is compared. The program uses two points to represent each secondary structure element (alpha helices or beta strands) then systematically searches all the possible super-positions of these elements in 3-dimensional space (defined as the root mean square deviation—rmsd, the angle between the two lines formed by the two points and the line-line distance). The program searches to determine whether additional secondary structure elements can fit by the same superposition operation. If secondary structures that can fit each other exceed a given number, the program identifies the two structures as similar. The program gives as an output a comparison score called "Structural Diversity" that considers the distance between matched α-carbon atoms and the number of matched residues. The lower the "Structural Diversity" score, the more the two structures are similar. In various embodiments herein, the Structural Diversity scores range from 0 up to about 67.

In the exemplified embodiment, all the cytokines were first structurally aligned against the IFNα-2b structure. For the proteins within the same family as IFNα-2b (e.g., the interferons/interleukin-10 cytokine family), this alignment was directly used to identify the structurally related is-HIT target amino acid positions and/or regions corresponding to the structurally homologous positions and/or regions on IFNα-2b where LEAD mutants were found (FIG. 8B). For the other cytokines, the protein of the family (either long- or short-chain cytokines) with the best 3-dimensional structural alignment with IFNα-2b was selected using the lowest "Structural Diversity" score as the representative for that family. From the short-chain cytokine protein family, erythropoietin (EPO; see FIG. 8C) was identified as the best structural homologue of IFNα-2b (rmsd=1.9 angstroms; number of aligned residues=62; Structural Diversity=13.8). From the long-chain cytokine protein family, granulocyte-colony stimulating factor (G-CSF; see FIG. 8D) was identified as the best structural homologue of IFNα-2b (rmsd=1.7 angstroms; number of aligned residues=77; Structural Diversity=7.8).

Next, the amino acid positions and/or regions corresponding to the LEAD mutant regions on IFNα-2b were identified on these two proteins. These two best structural homologues of IFNα-2b (e.g., EPO and G-CSF; see FIGS. 12L and 12E, respectively) were structurally aligned to each of the other cytokines within their respective cytokine protein families. As a result, protein regions likely to be targets for serum protease resistance were identified on all cytokines (see FIGS. 12A through T). Amino acids in these target regions were then checked for their exposure to the solvent and their susceptibility to be protease substrate. Exposed and substrate residues are then subjected to PAM250 analysis as set forth above, so that a group of non-substrate and functionally conservative amino acid residues are selected as replacements. The results of the above structural homology analysis for each of the cytokines provided herein are set forth in FIGS. 12A through T.

Accordingly, provided herein are modified cytokines that exhibit greater resistance to proteolysis compared to the unmodified cytokine protein, comprising one or more amino acid replacements at one or more target positions on the cytokine corresponding to a structurally-related modified amino acid position within the 3-dimensional structure of an IFNα-2b modified protein provided herein. The resistance to proteolysis can be measured by mixing it with a protease in vitro, incubation with blood or incubation with serum. Also provided herein are cytokine structural homologues of an IFNα-2b modified protein provided herein, comprising one or more amino acid replacements in the cytokine structural homologue at positions corresponding to the 3-dimensional-structurally-similar modified positions within the 3-dimensional structure of the modified IFNα-2b. In one embodiment, the cytokine homologue has increased resistance to proteolysis compared to its unmodified and/or wild type cytokine counterpart. Resistance to proteolysis can be measured by mixture with a protease in vitro, incubation with blood, or incubation with serum.

a. Structurally Homologous Interferon Mutants

Also provided herein are modified cytokines or cytokine structural homologues of IFNα-2b that are IFNα cytokines. These IFNα cytokines include, but are not limited to, IFNα-2a, IFNα-c, IFNα-2c, IFNα-d, IFNα-5, IFNα-6, IFNα-4, IFNα-4b, IFNα-I, IFNα-J, IFNα-H, IFNα-F, IFNα-8 and IFNα-consensus cytokine (see, SEQ ID No. 232). Accordingly, among the modified IFNα cytokines provided herein are those with one or more amino acid replacements at one or more target positions in either IFNα-2a, IFNα-c, IFNα-2c, IFNα-d, IFNα-5, IFNα-6, IFNα-4, IFNα-4b, IFNα-I, IFNα-J, IFNα-H, IFNα-F, IFNα-8, or IFNα-consensus cytokine corresponding to a structurally-related modified amino acid position within the 3-dimensional structure of the IFNα-2b modified proteins provided herein. The replacements lead to greater resistance to proteases, as assessed by incubation with a protease or a with a blood lysate or by incubation with serum, compared to the unmodified IFNα-2a.

In particular embodiments, the modified IFNα cytokines are selected from among:

the modified IFNα-2a that is human and is selected from among proteins comprising one or more single amino acid replacements in SEQ ID NO: 182, corresponding to amino acid positions: 41, 58, 78, 107, 117, 125, 133 and 159;

the modified IFNα-c that is human and is selected from among proteins comprising one or more single amino acid replacements in SEQ ID NO: 183, corresponding to amino acid positions: 41, 59, 79, 108, 118, 126, 134 and 160;

the modified IFNα-2c cytokine that is human and is selected from among cytokines comprising one or more single amino acid replacements in SEQ ID NO: 185, corresponding to amino acid positions: 41, 58, 78, 107, 117, 125, 133 and 159;

the IFNα-d modified protein that is human and is selected from among proteins comprising one or more single amino acid replacements in SEQ ID NO: 186, corresponding to amino acid positions: 41, 59, 79, 108, 118, 126, 134 and 160;

the IFNα-5 modified protein that is human and is selected from among proteins comprising one or more single amino acid replacements in SEQ ID NO: 187, corresponding to amino acid positions: 41, 59, 79, 108, 118, 126, 134 and 160;

the IFNα-6 modified protein that is human and is selected from among proteins comprising one or more single amino acid replacements in SEQ ID NO: 188, corresponding to amino acid positions: 41, 59, 79, 108, 118, 126, 134 and 160;

the IFNα-4 modified protein that is human and is selected from among proteins comprising one or more single amino acid replacements in SEQ ID NO: 189, corresponding to amino acid positions: 41, 59, 79, 108, 118, 126, 134 and 160;

the IFNα-4b modified protein that is human and is selected from among proteins comprising one or more single amino acid replacements in SEQ ID NO: 190, corresponding to amino acid positions: 41, 59, 79, 108, 118, 126, 134 and 160;

the IFNα-I modified protein that is human and is selected from among proteins comprising one or more single amino acid replacements in SEQ ID NO: 191, corresponding to amino acid positions: 41, 59, 79, 108, 118, 126, 134 and 160;

the IFNα-J modified protein that is human and is selected from among proteins comprising one or more single amino acid replacements in SEQ ID NO: 192, corresponding to amino acid positions: 41, 59, 79, 108, 118, 126, 134 and 160;

the IFNα-H modified protein that is human and is selected from among proteins comprising one or more single amino acid replacements in SEQ ID NO: 193, corresponding to amino acid positions: 41, 59, 79, 108, 118, 126, 134 and 160;

the IFNα-F modified protein that is human and is selected from among proteins comprising one or more single amino acid replacements in SEQ ID NO: 194, corresponding to amino acid positions: 41, 59, 79, 108, 118, 126, 134 and 160;

the IFNα-8 modified protein that is human and is selected from among proteins comprising one or more single amino acid replacements in SEQ ID NO: 195, corresponding to amino acid positions: 41, 59, 79, 108, 118, 126, 134 and 160; and the IFNα-consensus modified protein that is human and is selected from among proteins that contain one or more single amino acid replacements in SEQ ID NO: 232, corresponding to amino acid positions: 41, 58, 78, 107, 117, 125, 133 and 159.

b. Structurally Homologous Cytokine Mutants

As set forth above, provided herein are modified cytokines that contain one or more amino acid replacements at one or more target positions in either interleukin-10 (IL-10), interferon beta (IFNβ), IFNβ-1, IFNβ-2a, interferon gamma (IFN-γ), granulocyte colony stimulating factor (G-CSF), and human erythropoietin (EPO); corresponding to a structurally-related modified amino acid position within the 3-dimensional structure of the IFNα-2b modified proteins provided herein. The replacements lead to greater resistance to proteases, as assessed by incubation with a protease or a with a blood lysate or by incubation with serum, compared to the unmodified cytokine.

Also provided herein are modified cytokines that contain one or more amino acid replacements at one or more target positions in either granulocyte-macrophage colony stimulating factor (GM-CSF), interleukin-2 (IL-2), interleukin-3 (IL-3), interleukin-4 (IL-4), interleukin-5 (IL-5), interleukin-13 (IL-13), Flt3 ligand and stem cell factor (SCF); corresponding to a structurally-related modified amino acid position within the 3-dimensional structure of the human EPO modified proteins provided herein. The replacements lead to greater resistance to proteases, as assessed by incubation with a protease or a with a blood lysate or by incubation with serum, compared to the unmodified cytokine.

Also provided herein are modified cytokines that contain one or more amino acid replacements at one or more target positions in either interleukin-10 (IL-10), interferon beta (IFNβ), interferon gamma (IFN-γ), human granulocyte colony stimulating factor (G-CSF), leukemia inhibitory factor (LIF), human growth hormone (hGH), ciliary neurotrophic factor (CNTF), leptin, oncostatin M, interleukin-6 (IL-6) and interleukin-12 (IL-12); corresponding to a structurally-related modified amino acid position within the 3-dimensional structure of the human G-CSF modified proteins provided herein. The replacements lead to greater resistance to proteases, as assessed by incubation with a protease or a with a blood lysate or by incubation with serum, compared to the unmodified cytokine.

In particular embodiments, the modified cytokines are selected from the following:

A modified IFNβ cytokine, comprising mutations at one or more amino acid residues of IFNβ corresponding to SEQ ID NO: 196: 39, 42, 45, 47, 52, 67, 71, 73, 81, 107, 108, 109, 110, 111, 113, 116, 120, 123, 124, 128, 130, 134, 136, 137, 163 and 165. The mutations include insertions, deletions and replacements of the native amino acid residue(s). In particular embodiments, the replacements are selected from among amino acid substitutions in SEQ ID NO: 196 set forth in FIG. 12A corresponding to SEQ ID NOS: 233-289, where the first amino acid indicated is substituted by the second at the position indicated for all of the substitutions set forth in FIG. 12A through T.

A modified IFN-gamma cytokine, comprising mutations at one or more amino acid residues of IFN-gamma corresponding to SEQ ID NO:199: 33, 37, 40, 41, 42, 58, 61, 64, 65 and 66. The mutations include insertions, deletions and replacements of the native amino acid residue(s). In particular embodiments, the replacements are selected from among amino acid substitutions in SEQ ID NO:199 set forth in FIG. 12B corresponding to SEQ ID NOS: 290-311.

A modified IL-10 cytokine, comprising mutations at one or more amino acid residues of IL-10 corresponding to SEQ ID NO:200: 49, 50, 52, 53, 54, 55, 56, 57, 59, 60, 67, 68, 71, 72, 74, 75, 78, 81, 84, 85, 86, and 88. The mutations include insertions, deletions and replacements of the native amino acid residue(s). In exemplary embodiments, replacements are selected from among amino acid substitutions in SEQ ID NO:200 set forth in FIG. 12C corresponding to SEQ ID NOS: 312-361.

A modified erythropoietin cytokine, comprising mutations at one or more amino acid residues of erythropoietin corresponding to SEQ ID NO:201: 43, 45, 48, 49, 52, 53, 55, 72, 75, 76, 123, 129, 130, 131, 162, and 165. The mutations include insertions, deletions and replacements of the native amino acid residue(s). In exemplary embodiments, the replacements are selected from among amino acid substitutions in SEQ ID NO: 201 set forth in FIG. 12L corresponding to SEQ ID NOS: 940-977.

A modified GM-CSF cytokine, comprising mutations at one or more amino acid residues of GM-CSF corresponding to SEQ ID NO: 202: 38, 41, 45, 46, 48, 49, 51, 60, 63, 67, 92, 93, 119, 120, 123, and 124. The mutations include insertions, deletions and replacements of the native amino acid residue(s). In exemplary embodiments, the replacements are selected from among amino acid substitutions in SEQ ID NO: 202 set forth in FIG. 12N corresponding to SEQ ID NOS: 362-400.

A modified Flt3 ligand cytokine, comprising mutations at one or more amino acid residues of Flt3 ligand corresponding to SEQ ID NO: 203: 3, 40, 42, 43, 55, 58, 59, 61, 89, 90, 91, 95, and 96. The mutations include insertions, deletions and replacements of the native amino acid residue(s). In exemplary embodiments, the replacements are selected from among amino acid substitutions in SEQ ID NO: 203 set forth in FIG. 12M corresponding to SEQ ID NOS: 401-428.

A modified IL-2 cytokine, comprising mutations at one or more amino acid residues of IL-2 corresponding to SEQ ID NO: 204 at positions 43, 45, 48, 49, 52, 53, 60, 61, 65, 67, 68, 72, 100, 103, 104, 106, 107, 109, 110, and 132. The mutations include insertions, deletions and replacements of the native amino acid residue(s). In exemplary embodiments, the replacements are selected from among amino acid substitutions in SEQ ID NO: 204 set forth in FIG. 12P and SEQ ID NOS: 429-476.

A modified IL-3 cytokine, comprising mutations at one or more amino acid residues of IL-3 corresponding to SEQ ID NO: 205: 37, 43, 46, 59, 63, 66, 96, 100, 101, and 103. The mutations include insertions, deletions and replacements of the native amino acid residue(s). In exemplary embodiments, the replacements are selected from among amino acid substitutions in SEQ ID NO:205 set forth in FIG. 12Q corresponding to SEQ ID NOS: 477-498.

A modified SCF cytokine, comprising mutations at one or more amino acid residues of SCF corresponding to SEQ ID NO: 206: 27, 31, 34, 37, 54, 58, 61, 62, 63, 96, 98, 99, 100, 102, 103, 106, 107, 108, 109, 134, and 137. The mutations include insertions, deletions and replacements of the native amino acid residue(s). In exemplary embodiments, the replacements are selected from among amino acid substitutions in SEQ ID NO: 206 set forth in FIG. 12T corresponding to SEQ ID NOS: 499-542.

A modified IL-4 cytokine, comprising mutations at one or more amino acid residues of IL-4 corresponding to SEQ ID NO: 207: 26, 37, 53, 60, 61, 64, 66, 100, 102, 103, and 126. The mutations include insertions, deletions and replacements of the native amino acid residue(s). In exemplary embodiments, the replacements are selected from among amino acid substitutions in SEQ ID NO: 207 set forth in FIG. 12R corresponding to SEQ ID NOS: 543-567.

A modified IL-5 cytokine, comprising mutations at one or more amino acid residues of IL-5 corresponding to SEQ ID NO: 208: 32, 34, 39, 46, 47, 56, 84, 85, 88, 89, 90, 102, 110, and 111. The mutations include insertions, deletions and replacements of the native amino acid residue(s). In exemplary embodiments, the replacements are selected from among amino acid substitutions in SEQ ID NO: 208 set forth in FIG. 12S corresponding to SEQ ID NOS: 568-602.

A modified IL-13 cytokine, comprising mutations at one or more amino acid residues of IL-13 corresponding to SEQ ID NO: 209: 32, 34, 38, 48, 79, 82, 85, 86, 88, 107, 108, 110, and 111. The mutations include insertions, deletions and replacements of the native amino acid residue(s). In exemplary embodiments, the replacements are selected from among amino acid substitutions in SEQ ID NO: 209 set forth in FIG. 12O corresponding to SEQ ID NOS: 603-630.

A modified G-CSF cytokine, comprising mutations at one or more amino acid residues of G-CSF corresponding to SEQ ID NO: 210: 61, 63, 68, 72, 86, 96, 100, 101, 131, 133, 135, 147, 169, 172, and 177. The mutations include insertions, deletions and replacements of the native amino acid residue(s). In exemplary embodiments, the replacements are selected from among amino acid substitutions in SEQ ID NO: 210 set forth in FIG. 12E corresponding to SEQ ID NOS: 631-662.

A modified leptin cytokine, comprising mutations at one or more amino acid residues of leptin corresponding to SEQ ID NO: 211: 43, 49, 99, 100, 104, 105, 107, 108, 141 and 142. The mutations include insertions, deletions and replacements of the native amino acid residue(s). In exemplary embodiments, the replacements are selected from among amino acid substitutions in SEQ ID NO: 211 set forth in FIG. 12I corresponding to SEQ ID NOS: 663-683.

A modified CNTF cytokine, comprising mutations at one or more amino acid residues of CNTF corresponding to SEQ ID NO: 212: 62, 64, 66, 67, 86, 89, 92, 100, 102, 104, 131, 132, 133, 135, 136, 138, 140, 143, 148, and 151. The mutations include insertions, deletions and replacements of the native amino acid residue(s). In exemplary embodiments, the replacements are selected from among amino acid substitutions in SEQ ID NO: 212 set forth in FIG. 12D corresponding to SEQ ID NOS: 684-728.

A modified LIF cytokine, comprising mutations at one or more amino acid residues of LIF corresponding to SEQ ID NO: 213: 69, 70, 85, 99, 102, 104, 106, 109, 137, 143, 146, 148, 149, 153, 154, and 156. The mutations include insertions, deletions and replacements of the native amino acid residue(s). In exemplary embodiments, the replacements are selected from among amino acid substitutions in SEQ ID NO: 213 set forth in FIG. 12J corresponding to SEQ ID NOS: 729-760.

A modified oncostatin M cytokine, comprising mutations at one or more amino acid residues of oncostatin M corresponding to SEQ ID NO: 214: 59, 60, 63, 65, 84, 87, 89, 91, 94, 97, 99, 100, 103, and 106. The mutations include insertions, deletions and replacements of the native amino acid residue(s). In exemplary embodiments, the replacements are selected from among amino acid substitutions in SEQ ID NO: 214 set forth in FIG. 12K corresponding to SEQ ID NOS: 761-793.

A modified IL-12 cytokine, comprising mutations at one or more amino acid residues of IL-12 corresponding to SEQ ID NO: 215: 56, 61, 66, 67, 68, 70, 72, 75, 78, 79, 82, 89, 92, 93, 107, 110, 111, 115, 117, 124, 125, 127, 128, 129, and 189. The mutations include insertions, deletions and replacements of the native amino acid residue(s). In exemplary embodiments, the replacements are selected from among amino acid substitutions in SEQ ID NO: 215 set forth in FIG. 12G corresponding to SEQ ID NOS: 794-849.

A modified hGH cytokine, comprising mutations at one or more amino acid residues of hGH corresponding to SEQ ID NO: 216: 56, 59, 64, 65, 66, 88, 92, 94, 101, 129, 130, 133, 134, 140, 143, 145, 146, 147, 183, and 186. The mutations include insertions, deletions and replacements of the native amino acid residue(s). In exemplary embodiments, the replacements are selected from among amino acid substitutions in SEQ ID NO: 216 set forth in FIG. 12F corresponding to SEQ ID NOS: 850-895.

A modified IL-6 cytokine, comprising mutations at one or more amino acid residues of IL-6 corresponding to SEQ ID NO: 217: 64, 65, 66, 68, 69, 75, 77, 92, 98, 103, 105, 108, 133, 138, 139, 140, 149, 156, 178, and 181. The mutations include insertions, deletions and replacements of the native amino acid residue(s). In exemplary embodiments, the replacements are selected from among amino acid substitutions in SEQ ID NO: 217 set forth in FIG. 12H corresponding to SEQ ID NOS: 896-939.

In certain embodiments, the modified cytokines provided herein possess increased stability compared to the unmodified cytokine. Stability can be assessed by any in vitro or in vivo method, such as by measuring residual inhibition of viral replication or to stimulation of cell proliferation in appropriate cells, after incubation with either mixtures of proteases, individual proteases, blood lysate or serum.

In other embodiments, the modified cytokines provided herein possess decreased stability compared to the unmodified cytokine. Stability can be assessed by any in vitro or in vivo method, such as by measuring residual inhibition of viral replication or to stimulation of cell proliferation in appropriate cells, after incubation with either mixtures of proteases, individual proteases, blood lysate or serum.

In other embodiments, the modified cytokines provided herein possess increased activity compared to the unmodified cytokine. Stability can be assessed by any in vitro or in vivo method, such as by measuring residual inhibition of viral replication or to stimulation of cell proliferation in appropriate cells, after incubation with either mixtures of proteases, individual proteases, blood lysate or serum.

H. Rational Evolution of IFNβ for Increased Resistance to Proteolysis and/or Higher Conformational Stability Treatment with interferon β (IFNβ) is a well established therapy. Typically it is used for treatment of multiple sclerosis (MS). Patients receiving interferon β are subject to frequent repeat applications of the drug. The instability of IFNβ in the blood stream and under the storage conditions is well known. Hence it would be useful to increasing stability (half-life) of IFNβ in serum and also in vitro would improve it as a drug.

The 2D-scanning method and the 3D-scanning method (using structural homology) provided herein (see, copending U.S. application Ser. No. 10/658,355, filed Sep. 08, 2003, based on U.S. provisional application Ser. Nos. 60/457,063 and 60/410,258) were each applied to interferon β. Provided herein are mutant variants of the IFNβ protein that display improved stability as assessed by resistance to proteases (thereby possessing increased protein half-life) and at least comparable biological activity as assessed by antiviral or antiproliferation activity compared to the unmodified and wild type native IFNβ protein (SEQ ID NO: 196). The IFNβ mutant proteins provided herein confer a higher half-life and at least comparable biological activity with respect to the native sequence. Thus, the optimized IFNβ protein mutants provided herein that possess increased resistance to proteolysis result in a decrease in the frequency of injections needed to maintain a sufficient drug level in serum, thus leading to, for example: i) higher comfort and acceptance by patients, ii)

lower doses necessary to achieve comparable biological effects, and iii) as a consequence of (ii), likely attenuation of any secondary effects.

In exemplary embodiments, the half-life of the IFNβ mutants provided herein is increased by an amount selected from at least 10%, at least 20%, at least 30%, at least 40%, at least 50%, at least 60%, at least 70%, at least 80%, at least 90%, at least 100%, at least 150%, at least 200%, at least 250%, at least 300%, at least 350%, at least 400%, at least 450%, at least 500% or more, when compared to the half-life of native human IFNβ in either human blood, human serum or an in vitro mixture containing one or more proteases. In other embodiments, the half-life of the IFNβ mutants provided herein is increased by an amount selected from at least 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more, when compared to the half-life of native human IFNβ in either human blood, human serum or an in vitro mixture containing one or more proteases.

Two approaches were used herein to increase the stability of IFNβ by amino acid replacement: i) Resistance to proteases: amino acid replacement that leads to higher resistance to proteases by direct destruction of the protease target residue or sequence, while either maintaining or improving the requisite biological activity (e.g., antiviral and anti-proliferation activity), and/or ii) conformational stability: amino acid replacement that leads to an increase in conformational stability (i.e. half-life at room temperature or at 37° C.), while either improving or maintaining the requisite biological activity (e.g., antiviral and anti-proliferation activity).

Two methodologies were used to address the improvements described above: (a) 2D-scanning methods were used to identify amino acid changes that lead to improvement in protease resistance and to improvement in conformational stability, and (b) 3D-scanning, which employs structural homology methods also were used to identify amino acid changes that lead to improvement in protease resistance. The 2D-scanning and 3D-scanning methods each were used to identify the amino acid changes on IFNβ that lead to an increase in stability when challenged either with proteases, human blood lysate or human serum. Increasing protein stability to proteases, human blood lysate or human serum is contemplated herein to provide a longer in vivo half-life for the particular protein molecules, and thus a reduction in the frequency of necessary injections into patients. The biological activities that have been measured for the IFNβ molecules are i) their capacity to inhibit virus replication when added to permissive cells previously infected with the appropriate virus, and ii) their capacity to stimulate cell proliferation when added to the appropriate cells. Prior to the measurement of biological activity, IFNβ molecules were challenged with proteases, human blood lysate or human serum during different incubation times. The biological activity measured, corresponds then to the residual biological activity following exposure to the proteolytic mixtures.

As set forth above, provided herein are methods for the generating IFNβ molecules (or any target protein, particularly cytokines) that, while maintaining a requisite biological activity without substantial change (sufficient for therapeutic application(s)), have been rendered less susceptible to digestion by blood proteases and therefore display a longer half-life in blood circulation. In this particular example, the method used included the following specific steps as exemplified in the Examples:

For the improvement of resistance to proteases, by 2D-scanning, the method included:

1) Identifying some or all possible target sites on the protein sequence that are susceptible to digestion by one or more specific proteases (these sites are the is-HITs); and 2) Identifying appropriate replacing amino acids, specific for each is-HIT, such that if used to replace one or more of the original amino acids at that specific is-HIT, they can be expected to increase the is-HIT's resistance to digestion by protease while at the same time, keeping the biological activity of the protein unchanged (these replacing amino acids are the candidate LEADs).

For the improvement of resistance to proteases, by 3D-scanning (structural homology):

1) Identifying some or all possible target sites (is-HITS) on the protein sequence that display an acceptable degree of structural homology around the amino acid positions mutated in the LEAD molecules previously obtained for IFNα using 2D-scanning, and that are susceptible to digestion by one or more specific proteases; and 2) Identifying appropriate replacing amino acids, specific for each is-HIT, such that if used to replace one or more of the original amino acids at that specific is-HIT, they can be expected to increase the is-HIT's resistance to digestion by protease while at the same time, keeping the biological activity of the protein unchanged (these replacing amino acids are the candidate LEADs).

For the improvement of conformational stability, by 2D-scanning, as provided herein:

1) Identifying some or all possible target sites on the protein sequence that are susceptible to being directly involved in the intramolecular flexibility and conformational change (these sites are the is-HITs); and 2) Identifying appropriate replacing amino acids, specific for each is-HIT, such that if used to replace one or more of the original amino acids at that specific is-HIT, they can be expected to increase the thermal stability of the molecule while at the same time, keeping the biological activity of the protein unchanged (these replacing amino acids are the candidate LEADs). See FIGS. 6(O)-6(S) and FIG. 8(A).

Using the 2D-scanning and 3D-scanning methods and the 3-dimensional structure of IFNβ, the following amino acid target positions were identified as is-HITs on IFNβ, which numbering is that of the mature protein (SEQ ID NO:196):

By 3D-scanning (see, SEQ ID Nos.: 234-289, 989-1015): D by Q at position 39, D by H at position 39, D by G at position 39, E by Q at position 42, E by H at position 42, K by Q at position 45, K by T at position 45, K by S at position 45, K by H at position 45, L by V at position 47, L by I at position 47, L by T at position 47, L by Q at position 47, L by H at position 47, L by A at position 47, K by Q at position 52, K by T at position 52, K by S at position 52, K by H at position 52, F by I at position 67, F by V at position 67, R by H at position 71, R by Q at position 71, D by H at position 73, D by G at position 73, D by Q at position 73, E by Q at position 81, E by H at position 81, E by Q at position 107, E by H at position 107, K by Q at position 108, K by T at position 108, K by S at position 108, K by H at position 108, E by Q at position 109, E by H at position 109, D by Q at position 110, D by H at position 110, D by G at position 110, F by I at position 111, F by V at position 111, R by H at position 113, R by Q at position 113, L by V at position 116, L by I at position 116, L by T at position 116, L by Q at position 116, L by H at position 116, L by A at position 116, L by V at position 120, L by I at position 120, L by T at position 120, L by Q at position 120, L by H at position 120, L by A at position 120, K by Q at position 123, K by T at position 123, K by S at position 123, K by H at position 123, R by H at position 124, R by Q at position 124, R by H at position 128, R by Q at position 128, L by V at position 130, L by I at position 130, L by T at position 130, L by Q at position 130, L by H at position 130, L by A at position 130, K by Q at position 134, K by T at position 134, K by S at position 134, K by H at position 134, K by Q at position 136, K by T at position 136, K by S at position 136, K by H at position 136, E by Q at position 137, E by H at position 137, Y by H at position 163, Y by I at position 163, R by H at position 165, R by Q at position 165.

By 2D-scanning (see SEQ ID Nos.: 1016-1302): M by V at position 1, M by I at position 1, M by T at position 1, M by Q at position 1, M by A at position 1, L by V at position 5, L by I at position 5, L by T at position 5, L by Q at position 5, L by H at position 5, L by A at position 5, F by I at position 8, F by V at position 8, L by V at position 9, L by I at position 9, L by T at position 9, L by Q at position 9, L by H at position 9, L by A at position 9, R by H at position 11, R by Q at position 11, F by I at position 15, F by V at position 15, K by Q at position 19, K by T at position 19, K by S at position 19, K by H at position 19, W by S at position 22, W by H at position 22, N by H at position 25, N by S at position 25, N by Q at position 25, R by H position 27, R by Q position 27, L by V at position 28, L by I at position 28, L by T at position 28, L by Q at position 28, L by H at position 28, L by A at position 28, E by Q at position 29, E by H at position 29, Y by H at position 30, Y by I at position 30, L by V at position 32, L by I at position 32, L by T at position 32, L by Q at position 32, L by H at position 32, L by A at position 32, K by Q at position 33, K by T at position 33, K by S at position 33, K by H at position 33, R by H at position 35, R by Q at position 35, M by V at position 36, M by I at position 36, M by T at position 36, M by Q at position 36, M by A at position 36, D by Q at position 39, D by H at position 39, D by G at position 39, E by Q at position 42, E by H at position 42, K by Q at position 45, K by T at position 45, K by S at position 45, K by H at position 45, L by V at position 47, L by I at position 47, L by T at position 47, L by Q at position 47, L by H at position 47, L by A at position 47, K by Q at position 52, K by T at position 52, K by S at position 52, K by H at position 52, F by I at position 67, F by V at position 67, R by H at position 71, R by Q at position 71, D by Q at position 73, D by H at position 73, D by G at position 73, E by Q at position 81, E by H at position 81, E by Q at position 85, E by H at position 85, Y by H at position 92, Y by I at position 92, K by Q at position 99, K by T at position 99, K by S at position 99, K by H at position 99, E by Q at position 103, E by H at position 103, E by Q at position 104, E by H at position 104, K by Q at position 105, K by T at position 105, K by S at position 105, K by H at position 105, E by Q at position 107, E by H at position 107, K by Q at position 108, K by T at position 108, K by S at position 108, K by H at position 108, E by Q at position 109, E by H at position 109, D by Q at position 110, D by H at position 110, D by G at position 110, F by I at position 111, F by V at position 111, R by H at position 113, R by Q at position 113, L by V at position 116, L by I at position 116, L by T at position 116, L by Q at position 116, L by H at position 116, L by A at position 116, L by V at position 120, L by I at position 120, L by T at position 120, L by Q at position 120, L by H at position 120, L by A at position 120, K by Q at position 123, K by T at position 123, K by S at position 123, K by H at position 123, R by H at position 124, R by Q at position 124, R by H at position 128, R by Q at position 128, L by V at position 130, L by I at position 130, L by T at position 130, L by Q at position 130, L by H at position 130, L by A at position 130, K by Q at position 134, K by T at position 134, K by S at position 134, K by H at position 134, K by Q at position 136, K by T at position 136, K by S at position 136, K by H at position 136, E by Q at position 137, E by H at position 137, Y by H at position 138, Y by I at position 138, R by H at position 152, R by Q at position 152, Y by H at position 155, Y by I at position 155, R by H at position 159, R by Q at position 159, Y by H at position 163, Y by I at position 163, R by H at position 165, R by Q at position 165, M by D at position 1, M by E at position 1, M by K at position 1, M by N at position 1, M by R at position 1, M by S at position 1, L by D at position 5, L by E at position 5, L by K at position 5, L by N at position 5, L by R at position 5, L by S at position 5, L by D at position 6, L by E at position 6, L by K at position 6, L by N at position 6, L by R at position 6, L by S at position 6, L by Q at position 6, L by T at position 6, F by E at position 8, F by K at position 8, F by R at position 8, F by D at position 8, L by D at position 9, L by E at position 9, L by K at position 9, L by N at position 9, L by R at position 9, L by S at position 9, Q by D at position 10, Q by E at position 10, Q by K at position 10, Q by N at position 10, Q by R at position 10, Q by S at position 10, Q by T at position 10, S by D at position 12, S by E at position 12, S by K at position 12, S by R at position 12, S by D at position 13, S by E at position 13, S by K at position 13, S by R at position 13, S by N at position 13, S by Q at position 13, S by T at position 13, N by D at position 14, N by E at position 14, N by K at position 14, N by Q at position 14, N by R at position 14, N by S at position 14, N by T at position 14, F by D at position 15, F by E at position 15, F by K at position 15, F by R at position 15, Q by D at position 16, Q by E at position 16, Q by K at position 16, Q by N at position 16, Q by R at position 16, Q by S at position 16, Q by T at position 16, C by D at position 17, C by E at position 17, C by K at position 17, C by N at position 17, C by Q at position 17, C by R at position 17, C by S at position 17, C by T at position 17, L by N at position 20, L by Q at position 20, L by R at position 20, L by S at position 20, L by T at position 20, L by D at position 20, L by E at position 20, L by K at position 20, W by D at position 22, W by E at position 22, W by K at position 22, W by R at position 22, Q by D at position 23, Q by E at position 23, Q by K at position 23, Q by R at position 23, L by D at position 24, L by E at position 24, L by K at position 24, L by R at position 24, W by D at position 79, W by E at position 79, W by K at position 79, W by R at position 79, N by D at position 80, N by E at position 80, N by K at position 80, N by R at position 80, T by D at position 82, T by E at position 82, T by K at position 82, T by R at position 82, I by D at position 83, I by E at position 83, I by K at position 83, I by R at position 83, I by N at position 83, I by Q at position 83, I by S at position 83, I by T at position 83, N by D at position 86, N by E at position 86, N by K at position 86, N by R at position 86, N by Q at position 86, N by S at position 86, N by T at position 86, L by D at position 87, L by E at position 87, L by K at position 87, L by R at position 87, L by N at position 87, L by Q at position 87, L by S at position 87, L by T at position 87, A by D at position 89, A by E at position 89, A by K at position 89, A by R at position 89, N by D at position 90, N by E at position 90, N by K at position 90, N by Q at position 90, N by R at position 90, N by S at position 90, N by T at position 90, V by D at position 91, V by E at position 91, V by K at position 91, V by N at position 91, V by Q at position 91, V by R at position 91, V by S at position 91, V by T at position 91, Q by D at position 94, Q by E at position 94, Q by Q at position 94, Q by N at position 94, Q by R at position 94, Q by S at position 94, Q by T at position 94, I by D at position 95, I by E at position 95, I by K at position 95, I by N at position 95, I by Q at position 95, I by R at position 95, I by S at position 95, I by T at position 95, H by D at position 97, H by E at position 97, H by K at position 97, H by N at position 97, H by Q at position 97, H by R at position 97, H by S at position 97, H by T at position 97, L by D at position 98, L by E at position 98, L by K at position 98, L by N at position 98, L by Q at position 98, L by R at position 98, L by S at position 98, L by T at position 98, V by D at position 101, V by E at position 101, V by K at position 101, V by N at position 101, V by Q at position 101, V by R at position 101, V by S at position 101, V by T at position 101, M by C at position 1, L by C at position 6, Q by C at position 10, S by C at position 13, Q by C at position 16, L by C at position 17, V by C at position 101, L by C at position 98, H by C at position 97, Q by C at position 94, V by C at position 91, N by C at position 90.

| SEQ ID NO. | Mutant |
| --- | --- |
| SEQ ID No 1016 | (M1V) |
| SEQ ID No 1017 | (M1I) |
| SEQ ID No 1018 | (M1T) |
| SEQ ID No 1019 | (M1A) |
| SEQ ID No 1020 | (L5V) |
| SEQ ID No 1021 | (L5I) |
| SEQ ID No 1022 | (L5T) |
| SEQ ID No 1023 | (L5Q) |
| SEQ ID No 1024 | (L5H) |
| SEQ ID No 1025 | (L5A) |
| SEQ ID No 1026 | (F8I) |
| SEQ ID No 1027 | (F8V) |
| SEQ ID No 1028 | (L9V) |
| SEQ ID No 1029 | (L9I) |
| SEQ ID No 1030 | (L9T) |
| SEQ ID No 1031 | (L9Q) |
| SEQ ID No 1032 | (L9H) |
| SEQ ID No 1033 | (L9A) |
| SEQ ID No 1034 | (R11H) |
| SEQ ID No 1035 | (R11Q) |
| SEQ ID No 1036 | (F15I) |
| SEQ ID No 1037 | (F15V) |
| SEQ ID No 1038 | (K19Q) |
| SEQ ID No 1039 | (K19T) |
| SEQ ID No 1040 | (K19S) |
| SEQ ID No 1041 | (K19H) |
| SEQ ID No 1042 | (W22S) |
| SEQ ID No 1043 | (W22H) |
| SEQ ID No 1044 | (N25H) |
| SEQ ID No 1045 | (N25S) |
| SEQ ID No 1046 | (N25Q) |
| SEQ ID No 1047 | (R27H) |
| SEQ ID No 1048 | (R27Q) |
| SEQ ID No 1049 | (L28V) |
| SEQ ID No 1050 | (L28I) |
| SEQ ID No 1051 | (L28T) |
| SEQ ID No 1052 | (L28Q) |
| SEQ ID No 1053 | (L28H) |
| SEQ ID No 1054 | (L28A) |
| SEQ ID No 1055 | (E29Q) |
| SEQ ID No 1056 | (E29H) |
| SEQ ID No 1057 | (Y30H) |
| SEQ ID No 1058 | (Y30I) |
| SEQ ID No 1059 | (L32V) |
| SEQ ID No 1060 | (L32I) |
| SEQ ID No 1061 | (L32T) |
| SEQ ID No 1062 | (L32Q) |
| SEQ ID No 1063 | (L32H) |
| SEQ ID No 1064 | (L32A) |
| SEQ ID No 1065 | (M1Q) |
| SEQ ID No 1066 | (K33Q) |
| SEQ ID No 1067 | (K33T) |
| SEQ ID No 1068 | (K33S) |
| SEQ ID No 1069 | (K33H) |
| SEQ ID No 1070 | (R35H) |
| SEQ ID No 1071 | (R35Q) |
| SEQ ID No 1072 | (M36V) |
| SEQ ID No 1073 | (M36I) |
| SEQ ID No 1074 | (M36T) |
| SEQ ID No 1075 | (M36Q) |
| SEQ ID No 1076 | (M36A) |
| SEQ ID No 1077 | (E85Q) |
| SEQ ID No 1078 | (E85H) |
| SEQ ID No 1079 | (Y92H) |
| SEQ ID No 1080 | (Y92I) |
| SEQ ID No 1081 | (K99Q) |
| SEQ ID No 1082 | (K99T) |
| SEQ ID No 1083 | (K99S) |
| SEQ ID No 1084 | (K99H) |
| SEQ ID No 1085 | (E103Q) |
| SEQ ID No 1086 | (E103H) |
| SEQ ID No 1087 | (E104Q) |
| SEQ ID No 1088 | (E104H) |
| SEQ ID No 1089 | (K105Q) |
| SEQ ID No 1090 | (K105T) |
| SEQ ID No 1091 | (K105S) |
| SEQ ID No 1092 | (K105H) |
| SEQ ID No 1093 | (Y138H) |
| SEQ ID No 1094 | (Y138I) |
| SEQ ID No 1095 | (R152H) |
| SEQ ID No 1096 | (R152Q) |
| SEQ ID No 1097 | (Y155H) |
| SEQ ID No 1098 | (Y155I) |
| SEQ ID No 1099 | (R159H) |
| SEQ ID No 1100 | (R159Q) |
| SEQ ID No 1101 | (M1D) |
| SEQ ID No 1102 | (M1E) |
| SEQ ID No 1103 | (M1K) |
| SEQ ID No 1104 | (M1N) |
| SEQ ID No 1105 | (M1R) |
| SEQ ID No 1106 | (M1S) |
| SEQ ID No 1107 | (L5D) |
| SEQ ID No 1108 | (L5E) |
| SEQ ID No 1109 | (L5K) |
| SEQ ID No 1110 | (L5R) |
| SEQ ID No 1111 | (L5N) |
| SEQ ID No 1112 | (L5S) |
| SEQ ID No 1113 | (L6D) |
| SEQ ID No 1114 | (L6E) |
| SEQ ID No 1115 | (L6K) |
| SEQ ID No 1116 | (L6N) |
| SEQ ID No 1117 | (L6Q) |
| SEQ ID No 1118 | (L6R) |
| SEQ ID No 1119 | (L6S) |
| SEQ ID No 1120 | (L6T) |
| SEQ ID No 1121 | (F8D) |
| SEQ ID No 1122 | (F8E) |
| SEQ ID No 1123 | (F8K) |
| SEQ ID No 1124 | (F8R) |
| SEQ ID No 1125 | (L9D) |
| SEQ ID No 1126 | (L9E) |
| SEQ ID No 1127 | (L9K) |
| SEQ ID No 1128 | (L9N) |
| SEQ ID No 1129 | (L9R) |
| SEQ ID No 1130 | (L9S) |
| SEQ ID No 1131 | (Q10D) |
| SEQ ID No 1132 | (Q10E) |
| SEQ ID No 1133 | (Q10K) |
| SEQ ID No 1134 | (Q10N) |
| SEQ ID No 1135 | (Q10R) |
| SEQ ID No 1136 | (Q10S) |
| SEQ ID No 1137 | (Q10T) |
| SEQ ID No 1138 | (S12D) |
| SEQ ID No 1139 | (S12E) |
| SEQ ID No 1140 | (S12K) |
| SEQ ID No 1141 | (S12R) |
| SEQ ID No 1142 | (S13D) |
| SEQ ID No 1143 | (S13E) |
| SEQ ID No 1144 | (S13K) |
| SEQ ID No 1145 | (S13N) |
| SEQ ID No 1146 | (S13Q) |
| SEQ ID No 1147 | (S13R) |
| SEQ ID No 1148 | (S13T) |
| SEQ ID No 1149 | (N14D) |
| SEQ ID No 1150 | (N14E) |
| SEQ ID No 1151 | (N14K) |

-continued

| SEQ ID NO. | Mutant |
|---|---|
| SEQ ID No 1152 | (N14Q) |
| SEQ ID No 1153 | (N14R) |
| SEQ ID No 1154 | (N14S) |
| SEQ ID No 1155 | (N14T) |
| SEQ ID No 1156 | (F15D) |
| SEQ ID No 1157 | (F15E) |
| SEQ ID No 1158 | (F15K) |
| SEQ ID No 1159 | (F15R) |
| SEQ ID No 1160 | (Q16D) |
| SEQ ID No 1161 | (Q16E) |
| SEQ ID No 1162 | (Q16K) |
| SEQ ID No 1163 | (Q16N) |
| SEQ ID No 1164 | (Q16R) |
| SEQ ID No 1165 | (Q16S) |
| SEQ ID No 1166 | (Q16T) |
| SEQ ID No 1167 | (C17D) |
| SEQ ID No 1168 | (C17E) |
| SEQ ID No 1169 | (C17K) |
| SEQ ID No 1170 | (C17N) |
| SEQ ID No 1171 | (C17Q) |
| SEQ ID No 1172 | (C17R) |
| SEQ ID No 1173 | (C17S) |
| SEQ ID No 1174 | (C17T) |
| SEQ ID No 1175 | (L20N) |
| SEQ ID No 1176 | (L20Q) |
| SEQ ID No 1177 | (L20R) |
| SEQ ID No 1178 | (L20S) |
| SEQ ID No 1179 | (L20T) |
| SEQ ID No 1180 | (L20D) |
| SEQ ID No 1181 | (L20E) |
| SEQ ID No 1182 | (L20K) |
| SEQ ID No 1183 | (W22D) |
| SEQ ID No 1184 | (W22E) |
| SEQ ID No 1185 | (W22K) |
| SEQ ID No 1186 | (W22R) |
| SEQ ID No 1187 | (Q23D) |
| SEQ ID No 1188 | (Q23E) |
| SEQ ID No 1189 | (Q23K) |
| SEQ ID No 1190 | (Q23R) |
| SEQ ID No 1191 | (L24D) |
| SEQ ID No 1192 | (L24E) |
| SEQ ID No 1193 | (L24K) |
| SEQ ID No 1194 | (L24R) |
| SEQ ID No 1195 | (G78D) |
| SEQ ID No 1196 | (G78E) |
| SEQ ID No 1197 | (G78K) |
| SEQ ID No 1198 | (G78R) |
| SEQ ID No 1199 | (W79D) |
| SEQ ID No 1200 | (W79E) |
| SEQ ID No 1201 | (W79K) |
| SEQ ID No 1202 | (W79R) |
| SEQ ID No 1203 | (N80D) |
| SEQ ID No 1204 | (N80E) |
| SEQ ID No 1205 | (N80K) |
| SEQ ID No 1206 | (N80R) |
| SEQ ID No 1207 | (T82D) |
| SEQ ID No 1208 | (T82E) |
| SEQ ID No 1209 | (T82K) |
| SEQ ID No 1210 | (T82R) |
| SEQ ID No 1211 | (I83D) |
| SEQ ID No 1212 | (I83E) |
| SEQ ID No 1213 | (I83K) |
| SEQ ID No 1214 | (I83R) |
| SEQ ID No 1215 | (I83N) |
| SEQ ID No 1216 | (I83Q) |
| SEQ ID No 1217 | (I83S) |
| SEQ ID No 1218 | (I83T) |
| SEQ ID No 1219 | (N86D) |
| SEQ ID No 1220 | (N86E) |
| SEQ ID No 1221 | (N86K) |
| SEQ ID No 1222 | (N86R) |
| SEQ ID No 1223 | (N86Q) |
| SEQ ID No 1224 | (N86S) |
| SEQ ID No 1225 | (N86T) |
| SEQ ID No 1226 | (L87D) |
| SEQ ID No 1227 | (L87E) |
| SEQ ID No 1228 | (L87K) |
| SEQ ID No 1229 | (L87R) |
| SEQ ID No 1230 | (L87N) |
| SEQ ID No 1231 | (L87Q) |
| SEQ ID No 1232 | (L87S) |
| SEQ ID No 1233 | (L87T) |
| SEQ ID No 1234 | (A89D) |
| SEQ ID No 1235 | (A89E) |
| SEQ ID No 1236 | (A89K) |
| SEQ ID No 1237 | (A89R) |
| SEQ ID No 1238 | (N90D) |
| SEQ ID No 1239 | (N90E) |
| SEQ ID No 1240 | (N90K) |
| SEQ ID No 1241 | (N90Q) |
| SEQ ID No 1242 | (N90R) |
| SEQ ID No 1243 | (N90S) |
| SEQ ID No 1244 | (N90T) |
| SEQ ID No 1245 | (V91D) |
| SEQ ID No 1246 | (V91E) |
| SEQ ID No 1247 | (V91K) |
| SEQ ID No 1248 | (V91N) |
| SEQ ID No 1249 | (V91Q) |
| SEQ ID No 1250 | (V91R) |
| SEQ ID No 1251 | (V91S) |
| SEQ ID No 1252 | (V91T) |
| SEQ ID No 1253 | (Q94D) |
| SEQ ID No 1254 | (Q94E) |
| SEQ ID No 1255 | (Q94K) |
| SEQ ID No 1256 | (Q94N) |
| SEQ ID No 1257 | (Q94R) |
| SEQ ID No 1258 | (Q94S) |
| SEQ ID No 1259 | (Q94T) |
| SEQ ID No 1260 | (I95D) |
| SEQ ID No 1261 | (I95E) |
| SEQ ID No 1262 | (I95K) |
| SEQ ID No 1263 | (I95N) |
| SEQ ID No 1264 | (I95Q) |
| SEQ ID No 1265 | (I95R) |
| SEQ ID No 1266 | (I95S) |
| SEQ ID No 1267 | (I95T) |
| SEQ ID No 1268 | (H97D) |
| SEQ ID No 1269 | (H97E) |
| SEQ ID No 1270 | (H97K) |
| SEQ ID No 1271 | (H97N) |
| SEQ ID No 1272 | (H97Q) |
| SEQ ID No 1273 | (H97R) |
| SEQ ID No 1274 | (H97S) |
| SEQ ID No 1275 | (H97T) |
| SEQ ID No 1276 | (L98D) |
| SEQ ID No 1277 | (L98E) |
| SEQ ID No 1278 | (L98K) |
| SEQ ID No 1279 | (L98N) |
| SEQ ID No 1280 | (L98Q) |
| SEQ ID No 1281 | (L98R) |
| SEQ ID No 1282 | (L98S) |
| SEQ ID No 1283 | (L98T) |
| SEQ ID No 1284 | (V101D) |
| SEQ ID No 1285 | (V101E) |
| SEQ ID No 1286 | (V101K) |
| SEQ ID No 1287 | (V101N) |
| SEQ ID No 1288 | (V101Q) |
| SEQ ID No 1289 | (V101R) |
| SEQ ID No 1290 | (V101S) |
| SEQ ID No 1291 | (V101T) |
| SEQ ID No 1292 | (M1C) |
| SEQ ID No 1293 | (V101C) |
| SEQ ID No 1294 | (L6C) |
| SEQ ID No 1295 | (L98C) |
| SEQ ID No 1296 | (Q10C) |
| SEQ ID No 1297 | (H97C) |
| SEQ ID No 1298 | (S13C) |
| SEQ ID No 1299 | (Q94C) |
| SEQ ID No 1300 | (Q16C) |
| SEQ ID No 1301 | (N90C) |
| SEQ ID No 1302 | (V91C) |

I. Super-LEADs and Additive Directional Mutagenesis (ADM)

Also provided herein are super-LEAD mutant proteins comprising a combination of single amino acid mutations present in two or more of the respective LEAD mutant proteins. Thus, the super-LEAD mutant proteins have two of more of the single amino acid mutations derived from two or more of the respective LEAD mutant proteins. As described herein, LEAD mutant proteins provided herein are defined as mutants whose performance or fitness has been optimized with respect to the native protein. LEADs typically contain one single mutation relative to its respective native protein. This mutation represents an appropriate amino acid replacement that takes place at one is-HIT position. Further super-LEAD mutant proteins are created such that they carry on the same protein molecule, more than one LEAD mutation, each at a different is-HIT position. Once the LEAD mutant proteins have been identified using the 2D-scanning methods provided herein, super-LEADs can be generated by combining two or more individual LEAD mutant mutations using methods well-known in the art, such as recombination, mutagenesis and DNA shuffling, and by methods, such as additive directional mutagenesis and Multi-Overlapped Primer Extensions, provided herein.

1. Additive Directional Mutagenesis

Also provided herein are methods for assembling on a single mutant protein multiple mutations present on the individual LEAD molecules, so as to generate super-LEAD mutant proteins. This method is referred to herein as "Additive Directional Mutagenesis" (ADM). ADM is a repetitive multi-step process where at each step after the creation of the first LEAD mutant protein a new LEAD mutation is added onto the previous LEAD mutant protein to create successive super-LEAD mutant proteins. ADM is not based on genetic recombination mechanisms, nor on shuffling methodologies; instead it is a simple one-mutation-at-a-time process, repeated as many times as necessary until the total number of desired mutations is introduced on the same molecule. To avoid the exponentially increasing number of all possible combinations that can be generated by putting together on the same molecule a given number of single mutations, a method is provided herein that, although it does not cover all the combinatorial possible space, still captures a big part of the combinatorial potential. The word "combinatorial" is used here in its mathematical meaning (i.e., subsets of a group of elements, containing some of the elements in any possible order) and not in the molecular biological or directed evolution meaning (i.e., generating pools, or mixtures, or collections of molecules by randomly mixing their constitutive elements).

A population of sets of nucleic acid molecules encoding a collection of new super-LEAD mutant molecules is generated, tested and phenotypically characterized one-by-one in addressable arrays. super-LEAD mutant molecules are such that each molecule contains a variable number and type of LEAD mutations. Those molecules displaying further improved fitness for the particular feature being evolved, are referred to as super-LEADs. Super-LEADs may be generated by other methods known to those of skill in the art and tested by the high throughput methods herein. For purposes herein a super-LEAD typically has activity with respect to the function or biological activity of interest that differs from the improved activity of a LEAD by a desired amount, such as at least 10%, 20%, 30%, 40%, 50%, 60%, 70%, 80%, 90%, 100%, 150%, 200% or more from at least one of the LEAD mutants from which it is derived. In yet other embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more greater than at least one of the LEAD molecules from which it is derived. As with LEADs, the change in the activity for super-LEADs is dependent upon the activity that is being "evolved." The desired alteration, which can be either an increase or a reduction in activity, will depend upon the function or property of interest.

In one embodiment provided herein, the ADM method employs a number of repetitive steps, such that at each step a new mutation is added on a given molecule. Although numerous different ways are possible for combining each LEAD mutation onto a super-LEAD protein, an exemplary way the new mutations (e.g., mutation 1 (m1), mutation 2 (m2), mutation 3 (m3), mutation 4 (m4), mutation 5 (m5), mutation n (mn)) can be added corresponds to the following diagram:

m1
m1+m2
m1+m2+m3
m1+m2+m3+m4
m1+m2+m3+m4+m5
m1+m2+m3+m4+m5+ . . . +mn
m1+m2+m4
m1+m2+m4+m5
m1+m2+m4+m5+ . . . +mn
m1+m2+m5
m1+m2+m5+ . . . +mn
m2
m2+m3
m2+m3+m4
m2+m3+m4+m5
m2+m3+m4+m5+ . . . +mn
m2+m4
m2+m4+m5
m2+m4+m5+ . . . +mn
m2+m5
m2+m5+ . . . +mn
. . . , etc . . .

2. Multi-Overlapped Primer Extensions

In another embodiment, provided herein is a method for the rational evolution of proteins using oligonucleotide-mediated mutagenesis referred to as "multi overlapped primer extensions." This method can be used for the rational combination of mutant LEADs to form super-LEADS. This method allows the simultaneous introduction of several mutations throughout a small protein or protein-region of known sequence. Overlapping oligonucleotides of typically around 70 bases in length (since longer oligonucleotides lead to increased error) are designed from the DNA sequence (gene) encoding the mutant LEAD proteins in such a way that they overlap with each other on a region of typically around 20 bases. These overlapping oligonucleotides (including or not point mutations) act as both template and primers in a first step of PCR (using a proofreading polymerase, e.g., Pfu DNA polymerase, to avoid unexpected mutations) to create small amounts of full-length gene. The full-length gene resulting from the first PCR is then selectively amplified in a second step of PCR using flanking primers, each one tagged with a restriction site in order to facilitate subsequent cloning. One multi overlapped extension process yields a full-length (multi-mutated) nucleic acid molecule encoding a candidate super-LEAD protein having multiple mutations therein derived from LEAD mutant proteins.

Although typically about 70 bases are used to create the overlapping oligonucleotides, the length of additional overlapping oligonucleotides for use herein can range from about 30 bases up to about 100 bases, from about 40 bases up to about 90 bases, from about 50 bases up to about 80 bases, from about 60 bases up to about 75 bases, and from about 65 bases up to about 75 bases. As set forth above, typically about 70 bases are used herein.

Likewise, although typically the overlapping region of the overlapping oligonucleotides is about 20 bases, the length of other overlapping regions for use herein can range from about 5 bases up to about 40 bases, from about 10 bases up to about 35 bases, from about 15 bases up to about 35 bases, from about 15 bases up to about 25 bases, from about 16 bases up to about 24 bases, from about 17 bases up to about 23 bases, from about 18 bases up to about 22 bases, and from about 19 bases up to about 21 bases. As set forth above, typically about 20 bases are used herein for the overlapping region.

J. Uses of the Mutant IFNα and IFNβ Genes and Cytokines in Therapeutic Methods

The optimized cytokines provided herein, such as the IFNα-2b and IFNβ proteins and other modified cytokines, are intended for use in various therapeutic as well as diagnostic methods. These include all methods for which the unmodified proteins are used. By virtue of their improved phenotypes and activities, the proteins provided herein should exhibit improvement in the corresponding in vivo phenotype.

In particular, the optimized cytokines, such as the IFNα-2b and IFNβ proteins, are intended for use in therapeutic methods in which cytokines have been used for treatment. Such methods include, but are not limited to, methods of treatment of infectious diseases, allergies, microbial diseases, pregnancy related diseases, bacterial diseases, heart diseases, viral diseases, histological diseases, genetic diseases, blood related diseases, fungal diseases, adrenal diseases, cancers, liver diseases, autoimmune diseases, growth disorders, diabetes, neurodegenerative diseases, including multiple sclerosis, Parkinson's disease and Alzheimer's disease.

1. Fusion Proteins

Fusion proteins containing a targeting agent and mutant IFNα, including IFNα-2b and IFNα-2a, and IFNβ mutant proteins, or cytokine protein also are provided. Pharmaceutical compositions containing such fusion proteins formulated for administration by a suitable route are provided. Fusion proteins are formed by linking in any order the mutant protein and an agent, such as an antibody or fragment thereof, growth factor, receptor, ligand and other such agent for directing the mutant protein to a targeted cell or tissue. Linkage can be effected directly or indirectly via a linker. The fusion proteins can be produced recombinantly or chemically by chemical linkage, such as via heterobifunctional agents or thiol linkages or other such linkages. The fusion proteins can contain additional components, such as E. coli maltose binding protein (MBP) that aid in uptake of the protein by cells (see, International PCT application No. WO 01/32711).

2. Nucleic Acid Molecules for Expression

Nucleic acid molecules encoding the mutant cytokines including the mutant IFNβ proteins and IFNα proteins, such as the IFNα-2b and IFNα-2a proteins, provided herein, or the fusion protein operably linked to a promoter, such as an inducible promoter for expression in mammalian cells also are provided. Such promoters include, but are not limited to, CMV and SV40 promoters; adenovirus promoters, such as the E2 gene promoter, which is responsive to the HPV E7 oncoprotein; a PV promoter, such as the PBV p89 promoter that is responsive to the PV E2 protein; and other promoters that are activated by the HIV or PV or oncogenes.

The mutant cytokines including the mutant interferons (IFNα's and IFNβ's) proteins provided herein, also can be delivered to the cells in gene transfer vectors. The transfer vectors also can encode additional other therapeutic agent(s) for treatment of the disease or disorder, such cancer or HIV infection, for which the cytokine is administered.

3. Formulation of Optimized Cytokines and Methods of Treatment

Pharmaceutical compositions containing an optimized cytokine produced herein, such as IFNα-2b, IFNα-2a and IFNβ, fusion proteins or encoding nucleic acid molecules can be formulated in any conventional manner by mixing a selected amount of an optimized cytokine with one or more physiologically acceptable carriers or excipients. Selection of the carrier or excipient depends upon the mode of administration (i.e., systemic, local, topical or any other mode) and disorder treated. The pharmaceutical compositions provided herein can be formulated for single dosage administration. The concentrations of the compounds in the formulations are effective for delivery of an amount, upon administration, that is effective for the intended treatment. Typically, the compositions are formulated for single dosage administration. To formulate a composition, the weight fraction of a compound or mixture thereof is dissolved, suspended, dispersed or otherwise mixed in a selected vehicle at an effective concentration such that the treated condition is relieved or ameliorated. Pharmaceutical carriers or vehicles suitable for administration of the compounds provided herein include any such carriers known to those skilled in the art to be suitable for the particular mode of administration.

In addition, the compounds may be formulated as the sole pharmaceutically active ingredient in the composition or may be combined with other active ingredients. Liposomal suspensions, including tissue-targeted liposomes, may also be suitable as pharmaceutically acceptable carriers. These may be prepared according to methods known to those skilled in the art. For example, liposome formulations may be prepared as described in U.S. Pat. No. 4,522,811.

The active compound is included in the pharmaceutically acceptable carrier in an amount sufficient to exert a therapeutically useful effect in the absence of undesirable side effects on the patient treated. The therapeutically effective concentration may be determined empirically by testing the compounds in known in vitro and in vivo systems, such as the assays provided herein. The active compounds can be administered by any appropriate route, for example, orally, parenterally, intravenously, intradermally, subcutaneously, or topically, in liquid, semi-liquid or solid form and are formulated in a manner suitable for each route of administration.

The optimized cytokine and physiologically acceptable salts and solvates can be formulated for administration by inhalation (either through the mouth or the nose) or for oral, buccal, parenteral or rectal administration. For administration by inhalation, the optimized cytokine can be delivered in the form of an aerosol spray presentation from pressurized packs or a nebulizer, with the use of a suitable propellant, e.g., dichlorodifluoromethane, trichlorofluoromethane, dichlorotetrafluorethane, carbon dioxide or other suitable gas. In the case of a pressurized aerosol the dosage unit can be determined by providing a valve to deliver a metered amount. Capsules and cartridges of e.g., gelatin for use in an inhaler or insufflator can be formulated containing a powder mix of a therapeutic compound and a suitable powder base such as lactose or starch.

For oral administration, the pharmaceutical compositions can take the form of, for example, tablets or capsules prepared by conventional means with pharmaceutically acceptable excipients such as binding agents (e.g., pregelatinized maize starch, polyvinylpyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well known in the art. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, ethyl alcohol or fractionated vegetable oils); and preservatives (e.g., methyl or propyl-p-hydroxybenzoates or sorbic acid). The preparations can also contain buffer salts, flavoring, coloring and sweetening agents as appropriate.

Preparations for oral administration can be suitably formulated to give controlled release of the active compound. For buccal administration the compositions can take the form of tablets or lozenges formulated in conventional manner.

The optimized cytokine can be formulated for parenteral administration by injection e.g., by bolus injection or continuous infusion. Formulations for injection can be presented in unit dosage form e.g., in ampules or in multi-dose containers, with an added preservative. The compositions can take such forms as suspensions, solutions or emulsions in oily or aqueous vehicles, and can contain formulatory agents such as suspending, stabilizing and/or dispersing agents. Alternatively, the active ingredient can be in powder-lyophilized form for constitution with a suitable vehicle, e.g., sterile pyrogen-free water, before use.

In addition to the formulations described previously, the optimized cytokine also can be formulated as a depot preparation. Such long acting formulations can be administered by implantation (for example, subcutaneously or intramuscularly) or by intramuscular injection. Thus, for example, the therapeutic compounds can be formulated with suitable polymeric or hydrophobic materials (for example as an emulsion in an acceptable oil) or ion exchange resins, or as sparingly soluble derivatives, for example, as a sparingly soluble salt.

The active agents can be formulated for local or topical application, such as for topical application to the skin and mucous membranes, such as in the eye, in the form of gels, creams, and lotions and for application to the eye or for intracisternal or intraspinal application. Such solutions, particularly those intended for ophthalmic use, can be formulated as 0.01%-10% isotonic solutions, pH about 5-7, with appropriate salts. The compounds can be formulated as aerosols for topical application, such as by inhalation (see, e.g., U.S. Pat. Nos. 4,044,126, 4,414,209, and 4,364,923, which describe aerosols for delivery of a steroid useful for treatment inflammatory diseases, particularly asthma).

The concentration of active compound in the drug composition will depend on absorption, inactivation and excretion rates of the active compound, the dosage schedule, and amount administered as well as other factors known to those of skill in the art. For example, the amount that is delivered is sufficient to treat the symptoms of hypertension.

The compositions, if desired, can be presented in a package, in kit or a dispenser device, that can contain one or more unit dosage forms containing the active ingredient. The package, for example, contains metal or plastic foil, such as a blister pack. The pack or dispenser device can be accompanied by instructions for administration. The compositions containing the active agents can be packaged as articles of manufacture containing packaging material, an agent provided herein, and a label that indicates the disorder for which the agent is provided.

Methods of treatment of cytokine-mediated or cytokine-involved diseases and immunotherapeutic methods are provided. The modified cytokines can be used in any method of treatment for which the unmodified cytokine is used. Hence the modified cytokines can be used for treatment of all disorders noted herein for the respective cytokines and for those known to those of skill in the art for each of the others, such as immunotherapeutic treatment (interleukins) and red blood cell expansion and stem cell expansion. The following table summarizes exemplary uses in addition to those noted herein of exemplary modified cytokines provided herein:

| Cytokine | Exemplary Uses, Diseases and Treatment |
|---|---|
| IL-10 | anti-inflammatory treatment of chronic liver injury and disease; myeloma |
| Interferon-gamma | Interstitial/idiopathic pulmonary fibrosis; adjunctive immunotherapy for immunosuppressed patients |
| Granulocyte colony stimulating factor | Crohn's disease; cardiac disease; acquired and congenital neutropenias; asthma |
| Leukemia inhibitory factor | myocardial infarction; multiple sclerosis; prevention of axonal atrophy; olfactory epithelium replacement stimulation |
| Human growth hormone | growth hormone deficiency; acromegaly |
| Ciliary neurotrophic factor | retinal degeneration treatments; neurodegenerative diseases such as Huntington's; auditory degenerative diseases |
| Leptin | obesity; pancreatitis; endometriosis |
| Oncostatin M | chronic inflammatory diseases; rheumatoid arthritis; multiple sclerosis; tissue damage suppression |
| Interleukin-6 | Protection from liver injury; Crohn's disease; hematopoietic associated diseases |
| Interleukin-12 | coxsackievirus treatment; neuroblastoma; melanoma, renal cell carcinoma; mucosal immunity induction |
| Erythropoietin | hypoxia; myocardial ischemia; anemia with renal failure and cancer treatments |
| Granulocyte-macrophage colony stimulating factor | stimulate antigen presenting cells; anti-tumor activity for leukemia, melanoma, and breast, liver and renal cell carcinomas; adjunctive immunotherapy for immunosuppressed patients; autoimmune disease |
| Interleukin-2 | immune reactivation after chemotherapy; melanoma; colon carcinoma |
| Interleukin-3 | leukemia cell targeting; motor neuropathy; amyotrophic lateral sclerosis; asthma |
| Interleukin-4 | allergic asthma; lupus |
| Interleukin-5 | treatment for parasites; asthma; allergic diseases accompanied by eosinophilia |
| Interleukin-13 | intracellular infections; B-cell cancers; asthma |
| Flt3 ligand | prostate cancer; myeloid leukemia; engraftment of allogenic hematopoietic stem cells |
| Stem cell factor | hepatic injury; asthma; hematopoietic engraftment |

Treatment can be effected by any suitable route of administration using suitable formulations. If necessary, a particular dosage and duration and treatment protocol can be empirically determined or extrapolated.

K. EXAMPLES

The following examples are included for illustrative purposes only and are not intended to limit the scope of the invention. The specific methods exemplified can be practiced with other species. The examples are intended to exemplify generic processes.

Example 1

This example describes a plurality of chronological steps including steps from (i) to (viii):
(i) cloning of IFNα cDNA in a mammalian cell expression plasmid (section A.1)
(ii) generation of a collection of targeted mutants on the IFNα cDNA in the mammalian cell expression plasmid (section B)
(iii) production of IFNα mutants in mammalian cells (section C.1)
(iv) screening and partial in vitro characterization of IFNα mutants produced in mammalian cells in search of lead mutants (section D)
(v) cloning of the lead mutants into a bacterial cell expression plasmid (section A.2)
(vi) expression of lead mutants in bacterial cells (section C.2)
(vii) in vitro characterization of lead mutants produced in bacteria (section D)
(viii) in vivo characterization of lead mutants produced in bacteria (section E).

A. Cloning of Ifnα-2b Encoding cDNA

A.1. Cloning of IFNα-2b cDNA in a Mammalian Cell Expression Plasmid

The IFNα-2b cDNA was first cloned into a mammalian expression vector, prior to the generation of the selected mutations. A collection of mutants was then generated such that each individual mutant was created and processed individually, physically separated from each other and in addressable arrays. The mammalian expression vector pSSV9 CMV 0.3 pA was engineered as follows:

The pSSV9 CMV 0.3 pA was cut by PvuII and religated (this step gets rid of the ITR functions), prior to the introduction of a new EcoRI restriction site by Quickchange mutagenesis (Stratagene). The oligonucleotides primers were:

```
EcoRI forward primer
5'-GCCTGTATGATTATTGGATGTTGGAATTC-   (SEQ ID NO: 218)
CCTGATGCGGTATTTTCTCCTTACG-3'

EcoRI reverse primer
5'-CGTAAGGAGAAAATACCGCATCAGGGAATT-  (SEQ ID NO: 219)
CCAACATCCAATAAATCATACAGGC-3'.
```

The construct sequence was confirmed by using the following oligonucleotides:

```
Seq ClaI forward primer:
5'-CTGATTATCAACCGGGGTACATATGATTGA   (SEQ ID NO: 220)
C-ATGC-3'

Seq XmnI reverse primer
5'-TACGGGATAATACCGCGCCACATAGCAGAA-  (SEQ ID NO: 221)
C-3'.
```

Then, the XmnI-ClaI fragment containing the newly introduced EcoRI site was cloned into pSSV9 CMV 0.3 pA (SSV9 is a clone containing the entire adeno-associated virus (AAV) genome inserted into the PvuII site of plasmid pEMBL (see, Du et al. (1996) *Gene Ther* 3:254-261)) to replace the corresponding wild-type fragment and produce construct pSSV9-2EcoRI.

The DNA sequence of the IFNα-2b cDNA, which was inserted into the mammalian vector pDG6 (ATCC accession No. 53169), was confirmed using a pair of internal primers. The sequences of the IFNα-2b-related oligonucleotides for sequencing follow:

```
Seq forward primer:
5'-CCTGATGAAGGAGGACTC-3'         (SEQ ID NO: 222)

Seq reverse primer:
5'-CCAAGCAGCAGATGAGTC-3'.        (SEQ ID NO: 223)
```

Since the beginning of the IFNα-2b encoding cDNA (the signal peptide encoding sequence) is absent in pDG6, it was added using the oligonucleotide (see below) to the amplified gene. First, the IFNα-2b cDNA was amplified by PCR using pDG6 as template using the following oligonucleotides as primers:

```
IFNα-2b 5' primer
5'-TCAGCTGCAAGTCAAGCTGCTCTGTGGGCT  (SEQ ID NO: 224)
G-3'

IFNα-2b 3' primer
5'-GCTCTAGATCATTCCTTACTTCTTAAACTTT  (SEQ ID NO: 225)
C-TTGCAAGTTTGTTGAC-3'
```

The PCR product was then used in an overlapping PCR using the following oligonucleotide sequences, having Hind III or XbaI restriction sites (underlined) or the DNA sequence missing in pDG6 (underlined):

```
IFNα-2b HindIII primer
5'-CCCAAGCTTATGGCCTTGACCTTTGCTTTAC  (SEQ ID NO: 226)
T-GGTG-3'

IFNα-2b XbaI primer
5'-GCTCTAGATCATTCCTTACTTCTTAAACTTT  (SEQ ID NO: 227)
C-TTGCAAGTTTGTTGAC-3'

IFNα-2b 80 bp 5' primer
5'-CCCAAGCTTATGGCCTTGACCTTTGCTTTA-  (SEQ ID NO: 228)
CTGGTGGCCCTCCTGGTGCTCAGCTGCAAGTCAA
GCTGCTCTGTGGGCTG-3'.
```

The entire IFNα-2b cDNA was cloned into the pTOPO-TA vector (Invitrogen). After checking gene sequence by automatic DNA sequencing, the HindIII-XbaI fragment containing the gene of interest was subcloned into the corresponding sites of pSSV9-2EcoRI to produce pAAV-EcoRI-IFNalpha-2b (pNB-AAV-IFN alpha-2b).

A.2 Cloning of the IFN α-2b Leads in an *E. coli* Expression Plasmid

A.2.1 Characterization of the Bacterial Cells

BL21-CodonPlus(DE3)-RP® competent *Escherichia coli* cells are derived from Stratagene's high-performance BL21-Gold competent cells. These cells enable efficient high-level expression of heterologous proteins in *E. coli*. Efficient production of heterologous proteins in *E. coli* is frequently limited by the rarity, in *E. coli*, of certain tRNAs that are abundant in the organisms from which the heterologous proteins are derived. Availability of tRNAs allows high-level expression of many heterologous recombinant genes in BL21-Codon Plus cells that are poorly expressed in conventional BL21 strains.BL21-CodonPLus(DE3)-RP cells contain a ColE1-compatible, pACYC-based plasmid containing extra copies of the argu and proL tRNA genes.

A.2.2 Cloning of Wild-type IFNα

To express IFNα-2b in *E. coli* cDNA encoding the mature form of IFNα-2b was finally cloned into the plasmid pET-11

(Novagen). Briefly, this cDNA fragment was amplified by PCR using the primers SEQ ID Nos. 1306 and 1305, respectively:

```
FOR-IFNA-5' AACATATGTGTGATCTGCCTCAAACCCACAGCCTGGGT
AGC 3'

REV-IFNA-5' AAGGATCCTCATTCCTTACTTCTTAAACTTTCTTGCAA
GTTTGTTG 3',
``` from pSSV9-EcoRI-IFN α-2b (see above), which contains full-length IFN-2 alpha cDNA as a matrix, using Herculase DNA-polymerase (Stratagene). The PCR fragment was subcloned into pTOPO-TA vector (Invitrogen) yielding pTOPO-IFN α-2b. The sequence was verified by sequencing. pET11 IFN α-2b was prepared by insertion of the NdeI-Bam HI (Biolabs) fragment from pTOPO-IFN α-2b into the NdeI-Bam HI sites of pET 11. The DNA sequence of the resulting pET 11-IFN α-2b construct was verified by sequencing and the plasmid was used for IFN α-2b expression in *E. coli*.

A.2.3 Cloning of IFN α-2b Mutants from the Mammalian Expression Plasmid into the *E. coli* Expression Plasmid Lead mutants of Interferon alpha were first generated in the pSSV9-IFNα-EcoRI plasmid. With the only exception of E159H and E159Q, all mutants were amplified using the primers below. Primers contained NdeI (in Forward) and BamHI (in Reverse) restriction sites:

```
FOR-IFNA-5' AACATATGTGTGATCTGCCT    (SEQ ID No. 1306
CAAACCCACAGCCTGGGTAGC 3';
and REV-IFNA-5' AAGGATCCTCATTCCTTACT    (SEQ ID No. 1305)
TCTTAAACTTTCTTGCAAGTTTGTTG 3'.
```

Mutants E159H and E159Q were amplified using the following primers on reverse side (primer forward was the same than described above):

```
REV-IFNA-E159H-5' AAGGATCCTCATTCC    SEQ ID No. 1304
TTACTTCTTAAACTGTGTTGCAAGTTTGTTG 3'
above; and REV-IFNA-E159Q-5' AAGGATCCTCATTCC    SEQ ID No. 1305
TTACTTCTTAAACTCTGTTGCAAGTTTGTTG
3'.
```

Mutants were amplified with Pfu Turbo Polymerase (Stratagene). PCR products were cloned into pTOPO plasmid (Zero Blunt TOPO PCR cloning kit, Invitrogen). The presence of the desired mutations was checked by automatic sequencing. The NdeI+BamHI fragment of the pTOPO-IFNα positive clones was then cloned into NdeI+BamHII sites of the pET11 plasmid.

B. Construction of a collection of IFNα-2b Mutants in a Mammalian Expression Plasmid A series of mutagenic primers was designed to generate the appropriate site-specific mutations in the IFNα-2b cDNA. Mutagenesis reactions were performed with the Chameleon mutagenesis kit (Stratagene) using pNB-AAV-IFNα-2b as the template. Each individual mutagenesis reaction was designed to generate one single mutant protein. Each individual mutagenesis reaction contains one and only one mutagenic primer. For each reaction, 25 pmoles of each (phosphorylated) mutagenic primer were mixed with 0.25 pmoles of template, 25 pmoles of selection primer (introducing a new restriction site), and 2 μl of 10× mutagenesis buffer (100 mM Tris-acetate pH 7.5; 100 mM MgOAc; 500 mM KOAc pH 7.5) into each well of 96 well-plates. To allow DNA annealing, PCR plates were incubated at 98° C. during 5 min and immediately placed 5 min on ice, before incubating at room temperature during 30 min. Elongation and ligation reactions were allowed by addition of 7 μl of nucleotide mix (2.86 mM each nucleotide; 1.43× mutagenesis buffer) and 3 μl of a freshly prepared enzyme mixture of dilution buffer (20 mM Tris HCl pH 7.5; 10 mM KCl; 10 mM β-mercaptoethanol; 1 mM DTT; 0.1 mM EDTA; 50% glycerol), native T7 DNA polymerase (0.025 U/μl), and T4 DNA ligase (1 U/μl) in a ratio of 1:10, respectively. Reactions were incubated at 37° C. for 1 h before inactivation of T4 DNA ligase at 72° C. during 15 min. In order to eliminate the parental plasmid, 30 μl of a mixture containing 1× enzyme buffer and 10 U of restriction enzyme was added to the mutagenic reactions followed by incubation at 37° C. for at least 3 hours. Next, 90 μl aliquots of XLmutS competent cells (Stratagene) containing 25 mM β-mercaptoethanol were place in ice-chilled deep-well plates. Then, plates were incubated on ice for 10 min with gentle vortex every 2 min. Transformation of competent cells was performed by adding aliquots of the restriction reactions (1/10 of reaction volume) and incubating on ice for 30 min. A heat pulse was performed in a 42° C. water bath for 45 s, followed by incubation on ice for 2 minutes. Preheated SOC medium (0.45 ml) was added to each well and plates were incubated at 37° C. for 1 h with shaking. In order to enrich for mutated plasmids, 1 ml of 2×YT broth medium supplemented with 100 μg/ml ampicillin was added to each transformation mixture followed by overnight incubation at 37° C. with shaking. Plasmid DNA isolation was performed by alkaline lysis using Nucleospin Multi-96 Plus Plasmid Kit (Macherey-Nagel) according to the manufacturer's instructions. Selection of mutated plasmids was performed by digesting 500 μg of plasmid preparation with 10 U of selection endonuclease in an overnight incubation at 37° C. A fraction of the digested reactions (1/10 of the total volume) was transformed into 40 μl of Epicurian coli XL1-Blue competent cells (Stratagene) supplemented with 25 mM β-mercaptoethanol.

Transformation was performed was as described above. Transformants were selected on LB-ampicillin agar plates incubated overnight at 37° C. Isolated colonies were picked up and grown overnight at 37° C. into deep-well plates. Four clones per reaction were screened by endonuclease digestion of a new restriction site introduced by the selection primer. Finally, each mutation that was introduced to produce this collection of candidate LEAD IFNα-2b mutant plasmids encoding the proteins set forth in Table 2 of Example 2 was confirmed by automatic DNA sequencing.

C. Production of Ifnα-2b Mutants

C.1 In Mammalian Cells

IFNα-2b mutants were produced in 293 human embryo kidney (HEK) cells (obtained from ATCC), using Dulbecco's modified Eagle's medium supplemented with glucose (4.5 g/L; Gibco-BRL) and fetal bovine serum (10%, Hyclone). Cells were transiently transfected with the plasmids encoding the IFNα-2b mutants as follows: 0.6×10⁵ cells were seeded into 6 well-plates and grown for 36 h before transfection. Confluent cells at about 70%, were supplemented with 2.5 μg of plasmid (IFNα-2b mutants) and 10 mM poly-ethyleneimine (25 KDa PEI, Sigma-Aldrich). After gently shaking, cells were incubated for 16 h. Then, the culture medium was changed with 1 ml of fresh medium supplemented with 1% of serum. IFNα-2b was measured on culture supernatants obtained 40 h after transfection and stored in aliquots at −80° C. until use.

Supernatants containing IFNα-2b from transfected cells were screened following sequential biological assays as follows. Normalization of IFNα-2b concentration from culture supernatants was performed by enzyme-linked immunoabsorbent assay (ELISA) using a commercial kit (R & D) and following the manufacturer's instructions. This assay includes plates coated with an IFNα-2b monoclonal antibody that can be developed by coupling a secondary antibody conjugated to the horseradish peroxidase (HRP). IFNα-2b concentrations on samples containing (i) wild type IFNα-2b produced under comparable conditions as the mutants, (ii) the IFNα-2b mutants and (iii) control samples(produced from cells expressing GFP) were estimated by using an international reference standard provided by the NIBSC, UK.

C.2 In Bacteria

A volume of 200 ml of culture medium (LB/Ampicillin/Chloramphenicol) was inoculated with 5 ml of pre-culture BL21-pCodon+-pET-IFN α-2b muta overnight at 37° C. with constant shaking (225 rpm). The production of IFN α-2b was induced by the addition of 50 μl of 2M IPTG at $DO_{600\,nm}$~0.6.

The culture was continued for 3 additional hours and was centrifuged at 4° C. and 5000 g for 15 minutes. The supernatant (culture medium) was discarded and bacteria were lysed in 8 ml of lysis buffer by thermal shock (freezing-thawing: 37° C.-15 min; −80° C.-10 min; 37° C.-15 min; −80° C.-10 min; 37° C.-15 min). After centrifugation (10000 g, 15 min, 4° C.), the supernatant (soluble proteins fraction) was discarded, and the precipitated material (insoluble protein fraction containing the IFN α-2b protein as inclusion bodies) was purified.

C.3 Pre-Purification of IFN α-2b as Inclusion Bodies in *E. coli*

C.3.1 Washing of Inclusion Bodies by Sonication

Pellets containing the inclusion bodies were suspended in 10 ml of buffer and sonicated (80 watts) on ice, 1 second "on," 1 second "off" for a total of 4 min. Suspensions were then centrifuged (4° C., 10000 g, 15 min), and supernatants were recovered. Pellets were resuspended in 10 ml of buffer for a new sonication/centrifugation cycle. Triton X-100 was then eliminated by two additional cycles of sonication/centrifugation with buffer. Pellets containing the inclusion bodies were recovered and dissolved. The washed supernatants were stored at 4° C.

C.3.2 Solubilization of Inclusion Bodies by Denaturation

Once washed, the inclusion bodies were solubilized in buffer at a concentration estimated in 0.3 mg/ml measuring the OD280 (considering the coefficient of molar extinction of IFN α-2b). Solubilization was carried out overnight at 4° C., under shaking.

C.3.3 Renaturation of IFN α-2b by Dialysis of GdnHCl

Samples contained 1 mg of protein at 0.3 mg/ml (5 ml in total) in buffer. The GdnHCl (Guanidium hydrochloride) present in the samples was eliminated by dialysis (minimum membrane cut=10 kDa) overnight at 4° C. against buffer (1 liter) (final concentration of GdnHCl: 43 mM). Next, samples were further dialysed against 1 liter of buffer during 2.5 h. This step was repeated two additional times. After dialysis, very little precipitate was visible.

D. Screening and In Vitro Characterization of IFN α-2b Mutants

Two activities were measured directly on IFN samples: antiviral and antiproliferation activities. Dose (concentration)-response (activity) experiments for antiviral or antiproliferation activity permitted calculation of the "potency" for antiviral and antiproliferation activities, respectively. Antiviral and antiproliferation activities also were measured after incubation with proteolytic samples, such as specific proteases, mixtures of selected proteases, human serum or human blood. Assessment of activity following incubation with proteolytic samples allowed to determine the residual (antiviral or antiproliferation) activity and the respective kinetics of half-life upon exposure to proteases.

D.1. Antiviral Activity

IFNα-2b protects cells against viral infection by a complex mechanism devoted to create an unfavorable environment for viral proliferation. Cellular antiviral response due to IFNα-2b (IFN anti-viral assay) was assessed using an interferon-sensitive HeLa cell line (ATCC accession no. CCL-2) treated with the encephalomyocarditis virus (EMCV). The assessment of either the virus-induced cytopathic effects (CPE) or the amount of EMCV mRNA in extracts of infected cells by RT-PCR was used to determine IFNα activity in samples.

D.1.1 Antiviral Activity—Measure by RT-PCR

Confluent cells were trypsinized and plated at density $2 \times 10^4$ cells/well in DMEM 5% SVF medium (Day 0). Cells were incubated with IFN α-2b (at a concentration of 500 U/ml) to get 500 pg/ml and 150 pg/well (100 μl of IFN solution), during 24 h at 37° C. prior to be challenged with EMCV (1/1000 dilution; MOI 100). After an incubation of 16 h, when virus-induced CPE was near maximum in untreated cells, the number of EMCV particles in each well was determined by RT-PCR quantification of EMCV mRNA, using lysates of infected cells. RNA from cell extracts was purified after a DNAse/proteinase K treatment (Applied Biosystems). The CPE was evaluated using both Uptibleu (Interchim) and MTS (Promega) methods, which are based on detecting bioreductions produced by the metabolic activity of cells in a flourometric and calorimetric manner, respectively. In order to produce a standard curve for EMCV quantification, a 22 bp DNA fragment of the capsid protein-cDNA was amplified by PCR and cloned into pTOPO-TA vector (Invitrogen). Next, RT-PCR quantification of known amounts of pTOPO-TA-EMCV capsid gene was performed using the One-step RT-PCR kit (Applied Biosystems) and the following EMCV-related (cloning) oligonucleotides and probe:

```
EMCV forward primer
5'-CCCCTACATTGAGGCATCCA-3'        (SEQ ID NO: 229)

EMCV reverse primer
5'-CAGGAGCAGGACAAGGTCACT-3'       (SEQ ID NO: 230)

EMCV probe
5'-(FAM)CAGCCGTCAAGACCCAACCGCT    (SEQ ID NO: 231)
(TAMRA)-3'.
```

D.1.2 Antiviral Activity—Measure by CPE

Antiviral activity of IFN α-2b was determined by the capacity of the cytokine to protect HeLa cells against EMC (mouse encephalomyocarditis) virus-induced cytopathic effects. The day before, HeLa cells ($2 \times 10^5$ cells/ml) were seeded in flat-bottomed 96-well plates containing 100 μl/well of Dulbecco's MEM-GlutamaxI-sodium pyruvate medium supplemented with 5% SVF and 0.2% of gentamicin. Cells were growth at 37° C. in an atmosphere of 5% $CO_2$ for 24 hours.

Two-fold serial dilutions of interferon samples were made with MEM complete media into 96-Deep-Well plates with final concentration ranging from 1600 to 0.6 pg/ml. The medium was aspirated from each well and 100 μl of interferon dilutions were added to HeLa cells. Each interferon sample dilution was assessed in triplicate. The two last rows of the plates were filled with 100 µl of medium without interferon dilution samples in order to serve as controls for cells with and without virus.

After 24 hours of growth, a 1/1000 EMC virus dilution solution was placed in each well except for the cell control row. Plates were returned to the $CO_2$ incubator for 48 hours. Then, the medium was aspirated and the cells were stained for 1 hour with 100 µl of Blue staining solution to determine the proportion of intact cells. Plates were washed in a distilled water bath. The cell bound dye was extracted using 100 µl of ethylene-glycol mono-ethyl-ether (Sigma). The absorbance of the dye was measured using an Elisa plate reader (Spectramax). The antiviral activity of IFN α-2b samples (expressed as number of IU/mg of proteins) was determined as the concentration needed for 50% protection of the cells against EMC virus-induced cytopathic effects. For proteolysis experiments, each point of for the kinetic measurements was assessed at 500 and 166 pg/ml in triplicate.

D.2 Antiproliferation Activity

Anti-proliferative activity of interferon α-2b was determined by the capacity of the cytokine to inhibit proliferation of Daudi cells. Daudi cells ($1 \times 10^4$ cells) were seeded in flat-bottomed 96-well plates containing 50 µl/well of RPMI 1640 medium supplemented with 10% SVF, 1× glutamine and 1 ml of gentamicin. No cell was added to the last row ("H" row) of the flat-bottomed 96-well plates in order to evaluate background absorbance of culture medium.

At the same time, two-fold serial dilutions of interferon samples were made with RPMI 1640 complete media into 96-Deep-Well plates with final concentration ranging from 6000 to 2.9 pg/ml. Interferon dilutions (50 µl) were added to each well containing 50 µl of Daudi cells. The total volume in each well should now be 100 µl. Each interferon sample dilution was assessed in triplicate. Each well of the "G" row of the plates was filled with 50 µl of RPMI 1640 complete media in order to be used as positive control. The plates are incubated for 72 hours at 37° C. in a humidified, 5% $CO_2$ atmosphere.

After 72 hours of growth, 20 µl of Cell titer 96 Aqueous one solution reagent (Promega) was added to each well and incubated 1H30 at 37° C. in an atmosphere of 5% $CO_2$. To measure the amount of colored soluble formazan produced by cellular reduction of the MTS, the absorbance of the dye was measured using an Elisa plate reader (Spectramax) at 490 nm.

The corrected absorbances ("H" row background value subtracted) obtained at 490 nm were plotted versus concentration of cytokine. The ED50 value was calculated by determining the X-axis value corresponding to one-half the difference between the maximum and minimum absorbance values. (ED50=the concentration of cytokine necessary to give one-half the maximum response).

D.3 Treatment of IFN α-2b with Proteolytic Preparations

Mutants were treated with proteases in order to identify resistant molecules. The resistance of the mutant IFN α-2b molecules compared to wild-type IFN α-2b against enzymatic cleavage (30 min, 25° C.) by a mixture of proteases (containing 1.5 µg of each of the following proteases (1% wt/wt, Sigma): α-chymotrypsin, carboxypeptidase, endoproteinase Arg-C, endoproteinase Asp-N, endoproteinase Glu-C, endoproteinase Lys-C, and trypsin) was determined. At the end of the incubation time, 10 µl of anti-proteases complete, mini EDTA free, Roche (one tablet was dissolved in 10 ml of DMEM and then diluted to 1/1000) was added to each reaction in order to inhibit protease activity. Treated samples were then used to determine residual antiviral or antiproliferation activities.

D.4 Protease Resistance—Kinetic Analysis

The percent of residual IFN α-2b activity over time of exposure to proteases was evaluated by a kinetic study using either (a) 15 pg of chymotrypsin (10% wt/wt), (b) a lysate of human blood at dilution 1/100, (c) 1.5 pg of protease mixture, or (d) human serum. Incubation times were: 0 h, 0.5 h, 1 h, 4 h, 8 h, 16 h, 24 h and 48 h. Briefly, 20 µl of each proteolytic sample (proteases, serum, blood) was added to 100 µl of IFN α-2b at 1500 pg/ml (500 U/ml) and incubated for variable times, as indicated. At the appropriate time points, 10 µl of anti-proteases mixture, mini EDTA free, Roche (one tablet was dissolved in 10 ml of DMEM and then diluted to 1/500) was added to each well in order to stop proteolysis reactions. Biological activity assays were then performed as described for each sample in order to determine the residual activity at each time point.

D.5 Performance

The various biological activities, protease resistance and potency of each individual mutant were analyzed using a mathematical model and algorithm (NautScan™; described in French Patent No. 9915884; (published as International PCT application No. WO 01/44809 based on PCT no PCT/FR00/03503). Data was processed using a Hill equation-based model that uses key feature indicators of the performance of each individual mutant. Mutants were ranked based on the values of their individual performance and those on the top of the ranking list were selected as leads.

E. Pharmacokinetics of Selected Lead Mutants in Mice

Figure 1B:
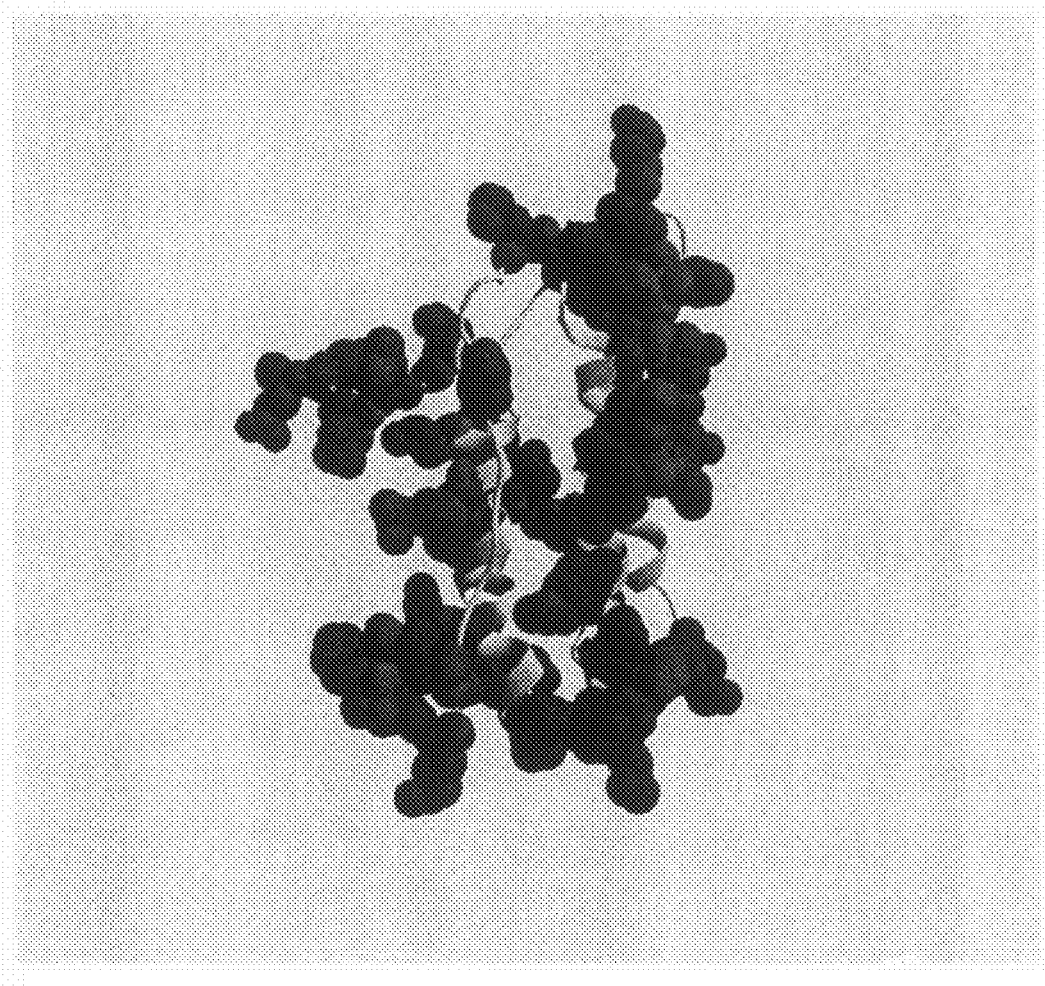
Figure 4B:
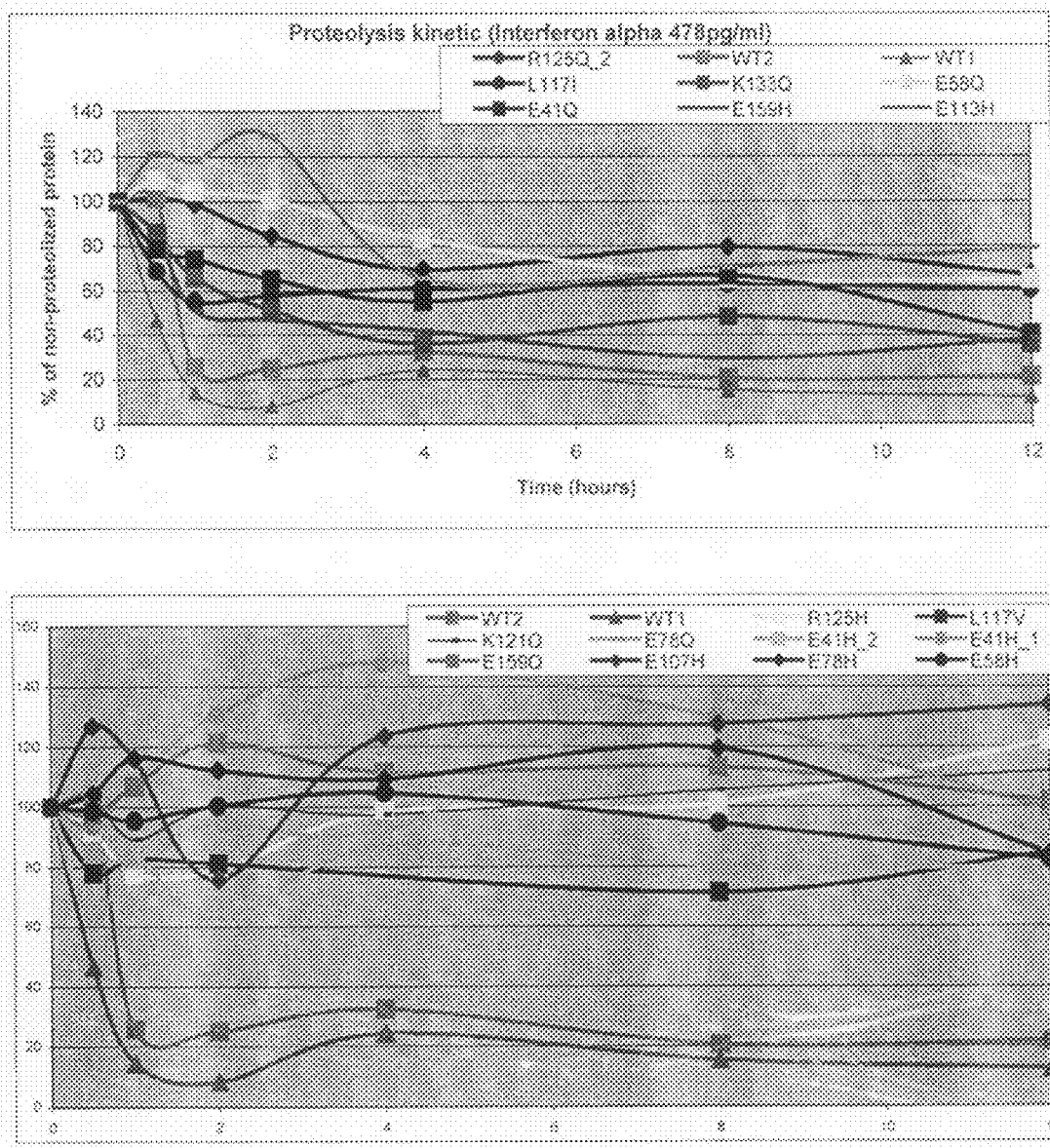
Figure 4C:
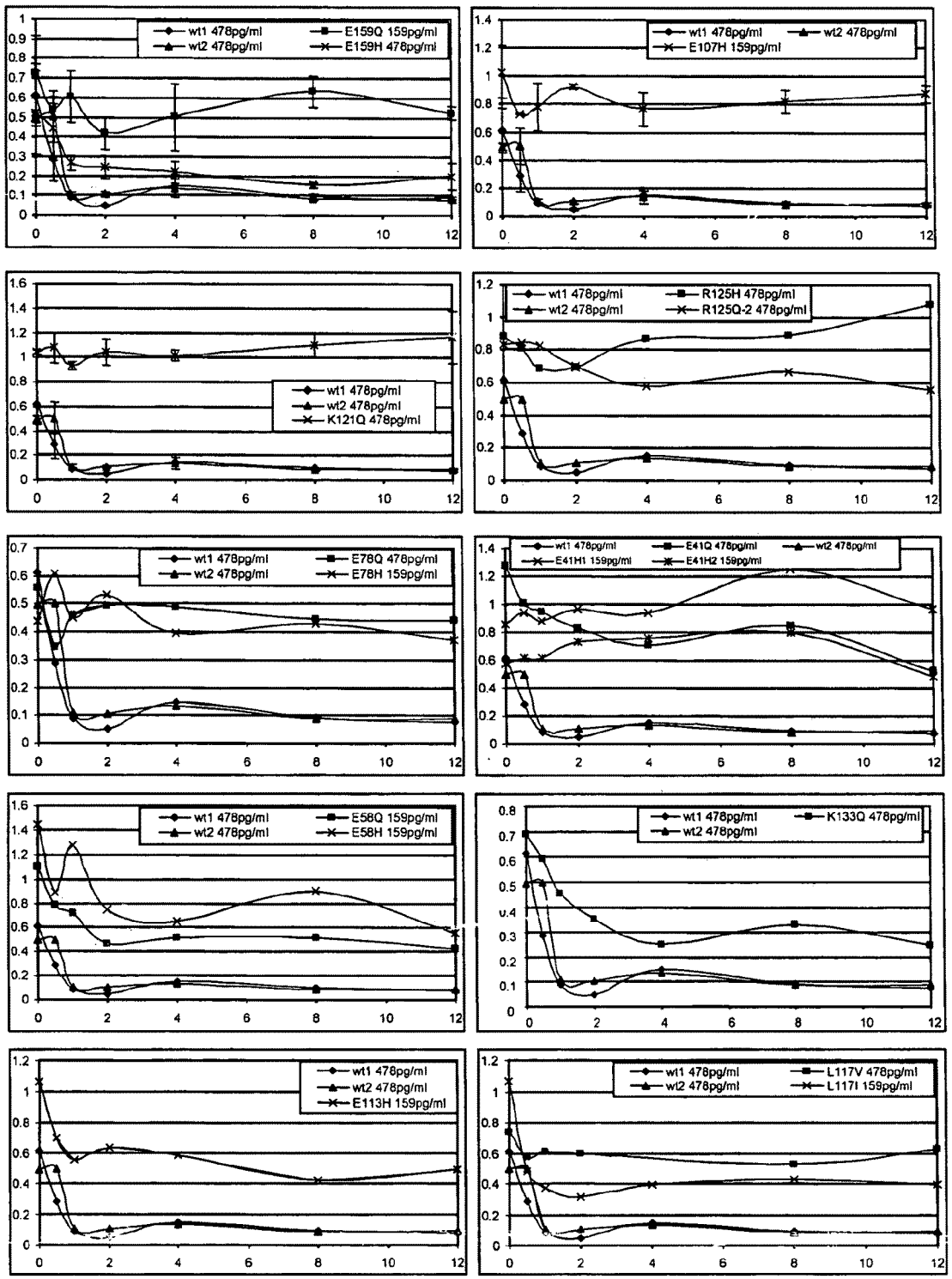
Figure 5:
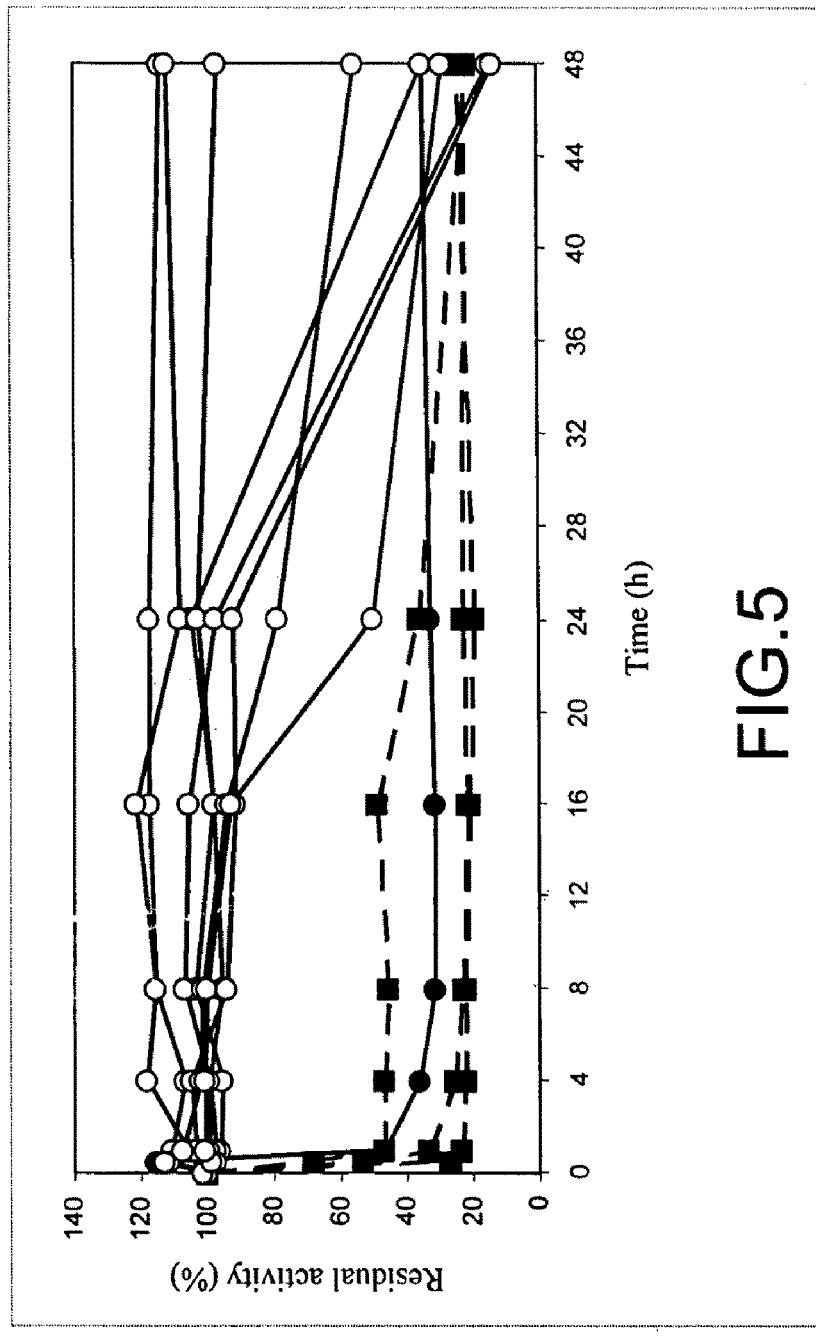
Figure 6A:
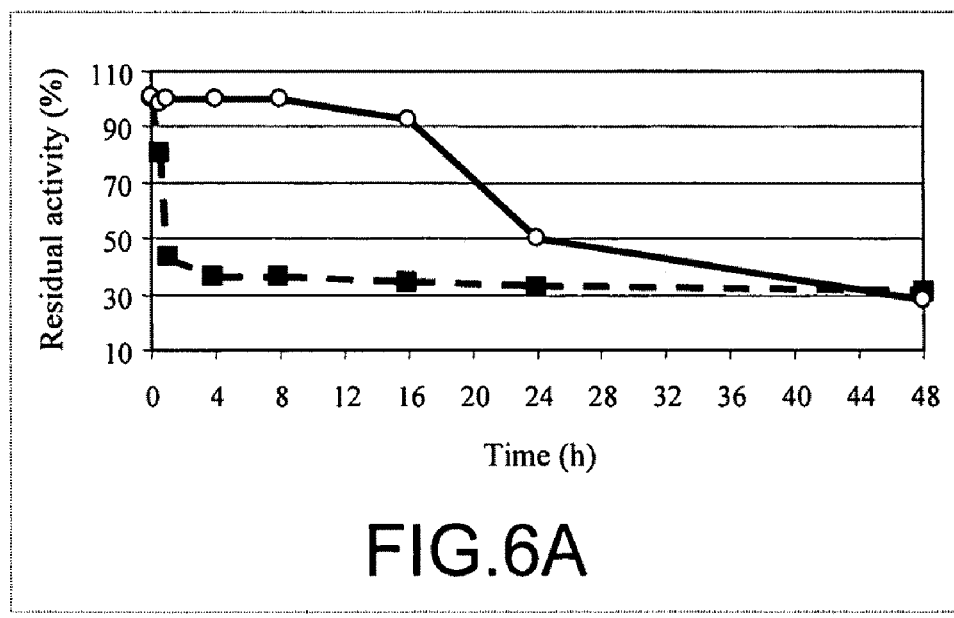
Figure 6B:
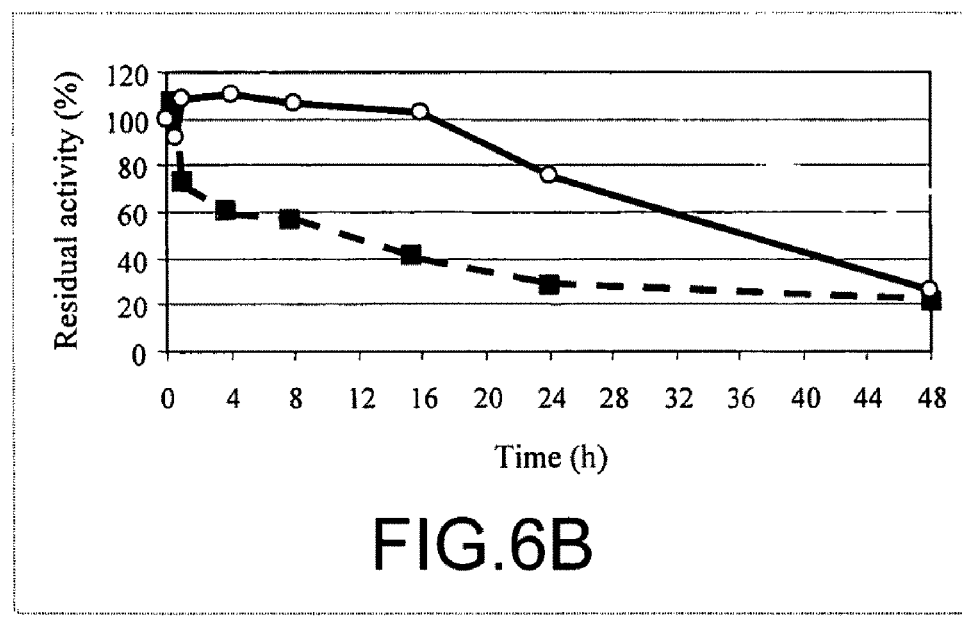
Figure 6C:
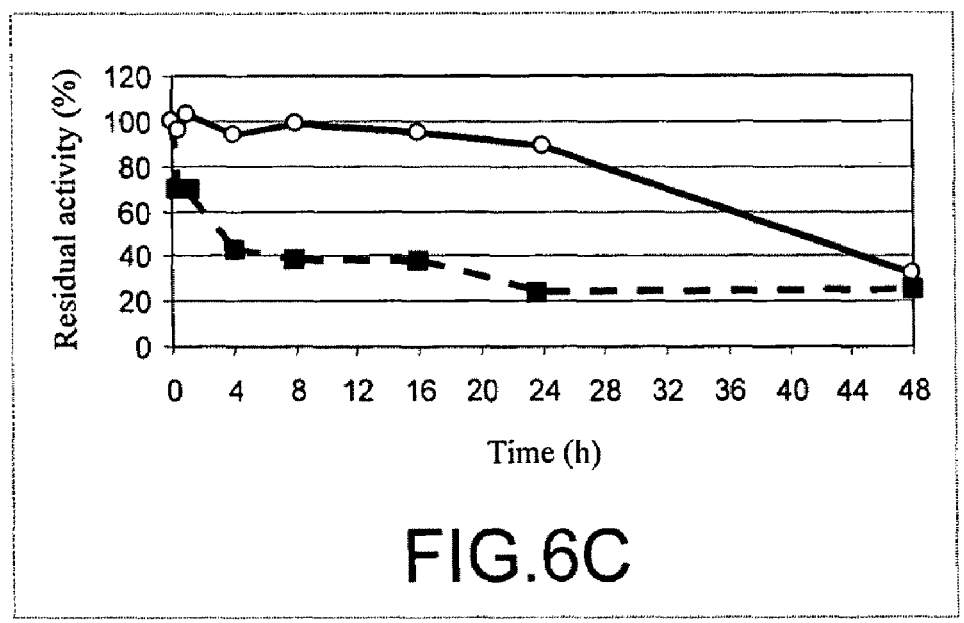
Figure 6D:
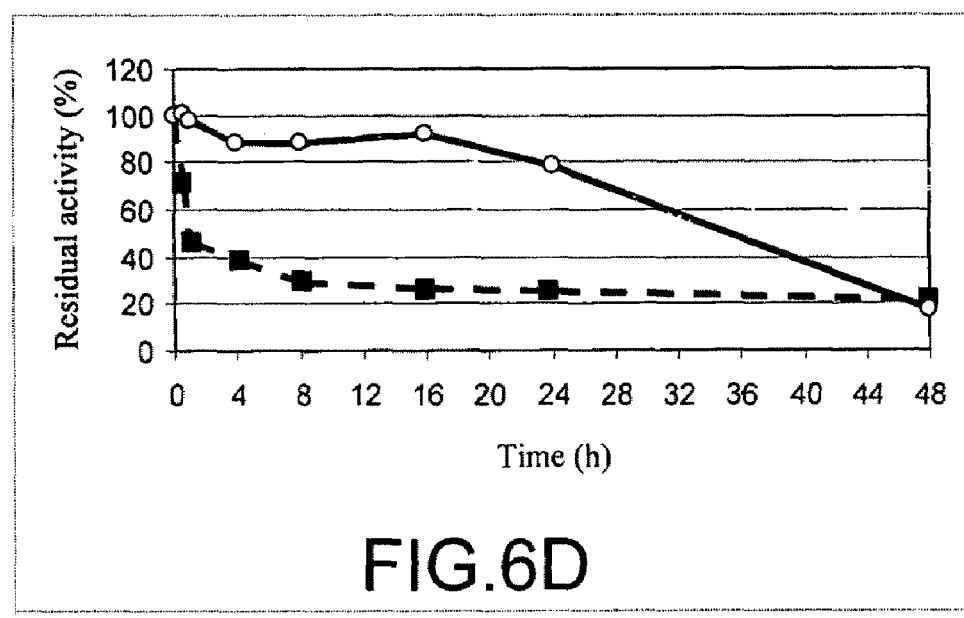
Figure 6E:
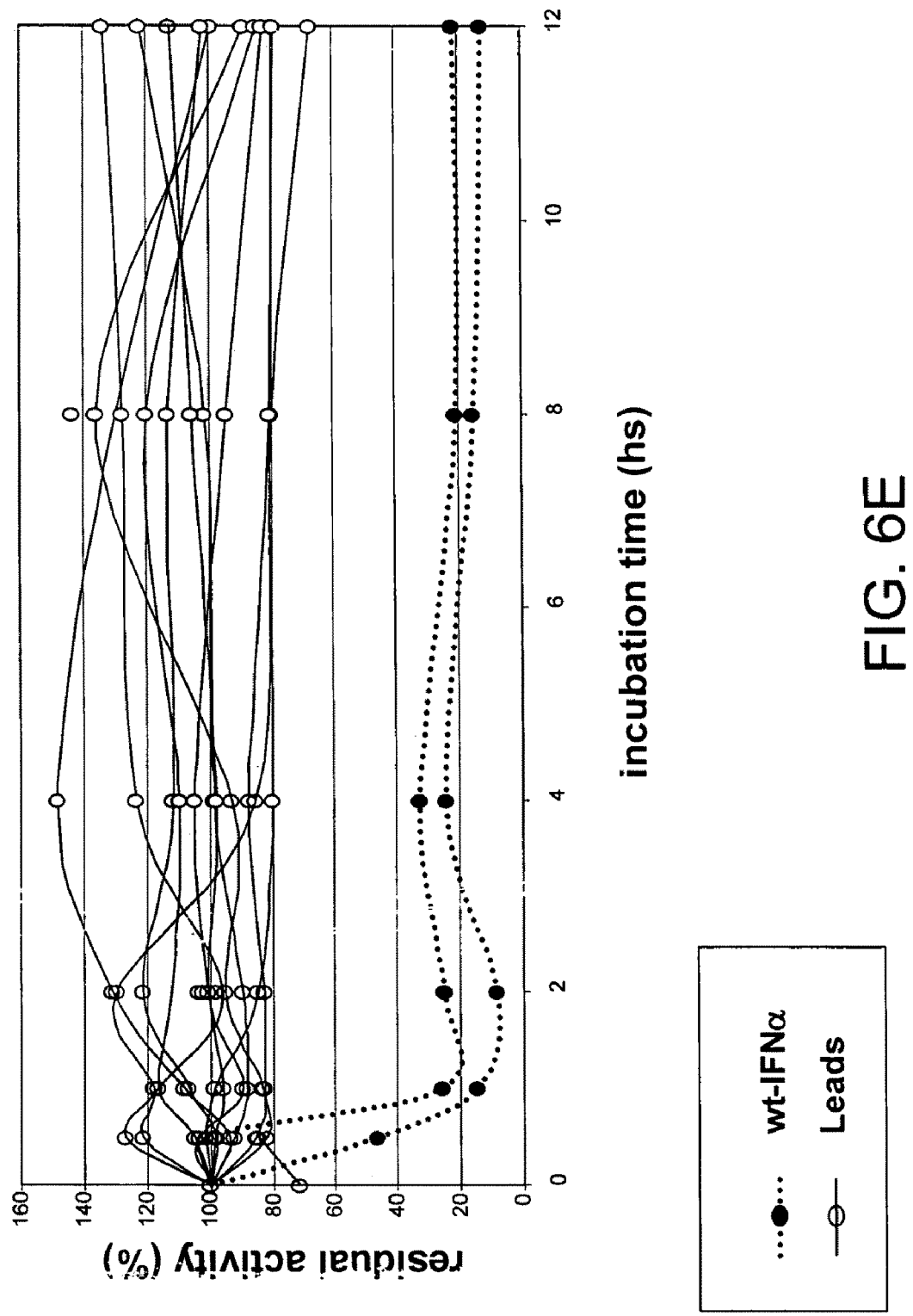
Figure 6F:
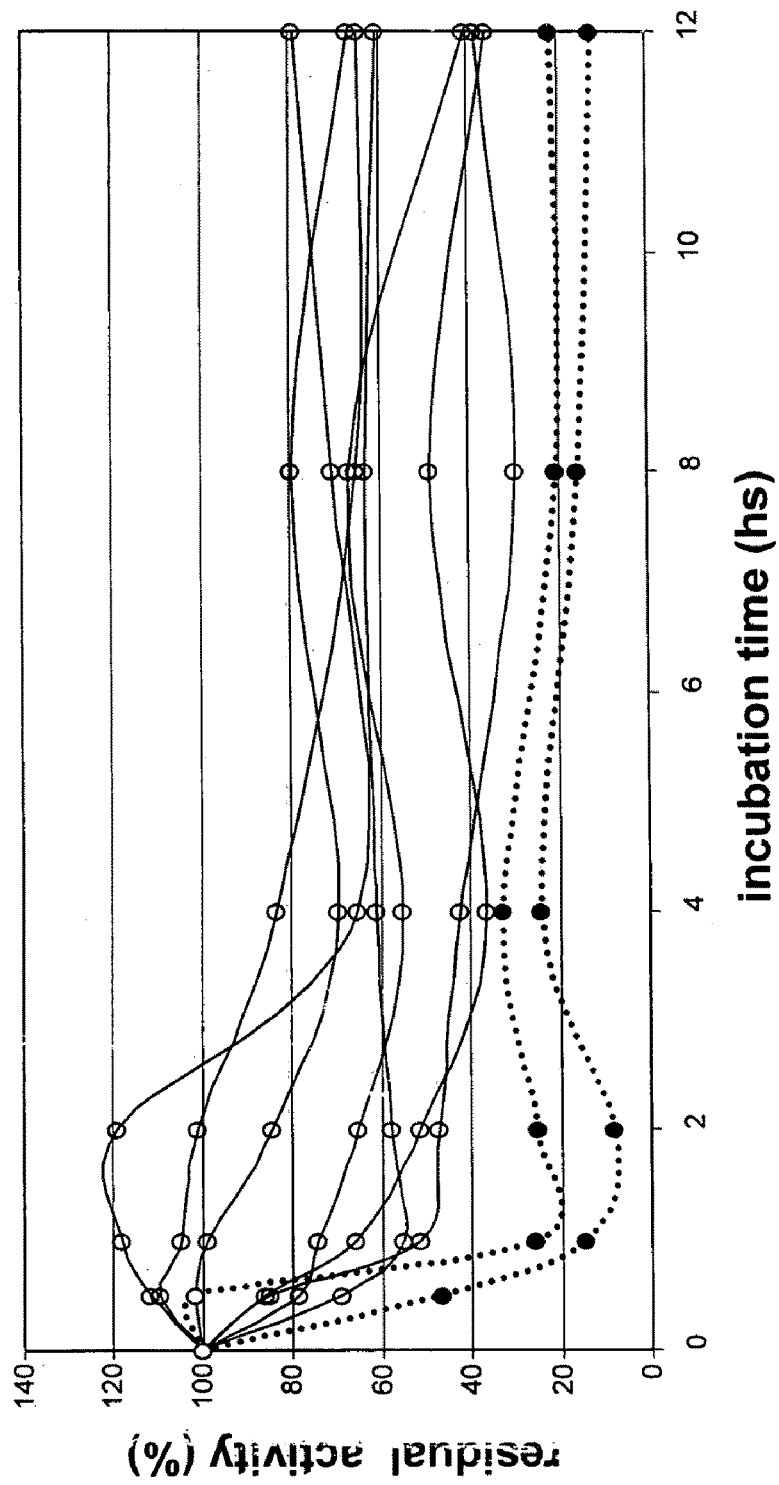
Figure 6G:
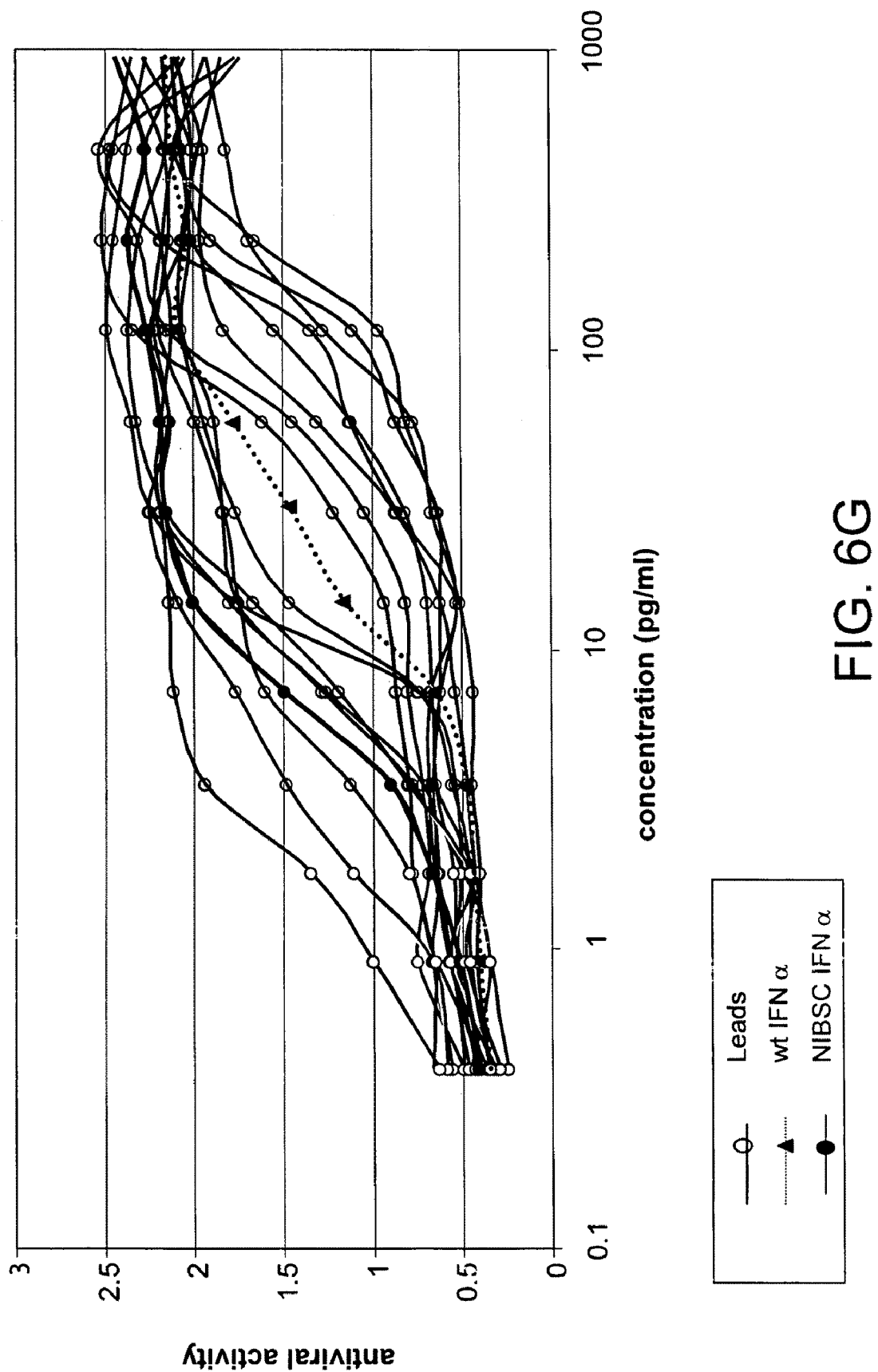
Figure 6I:
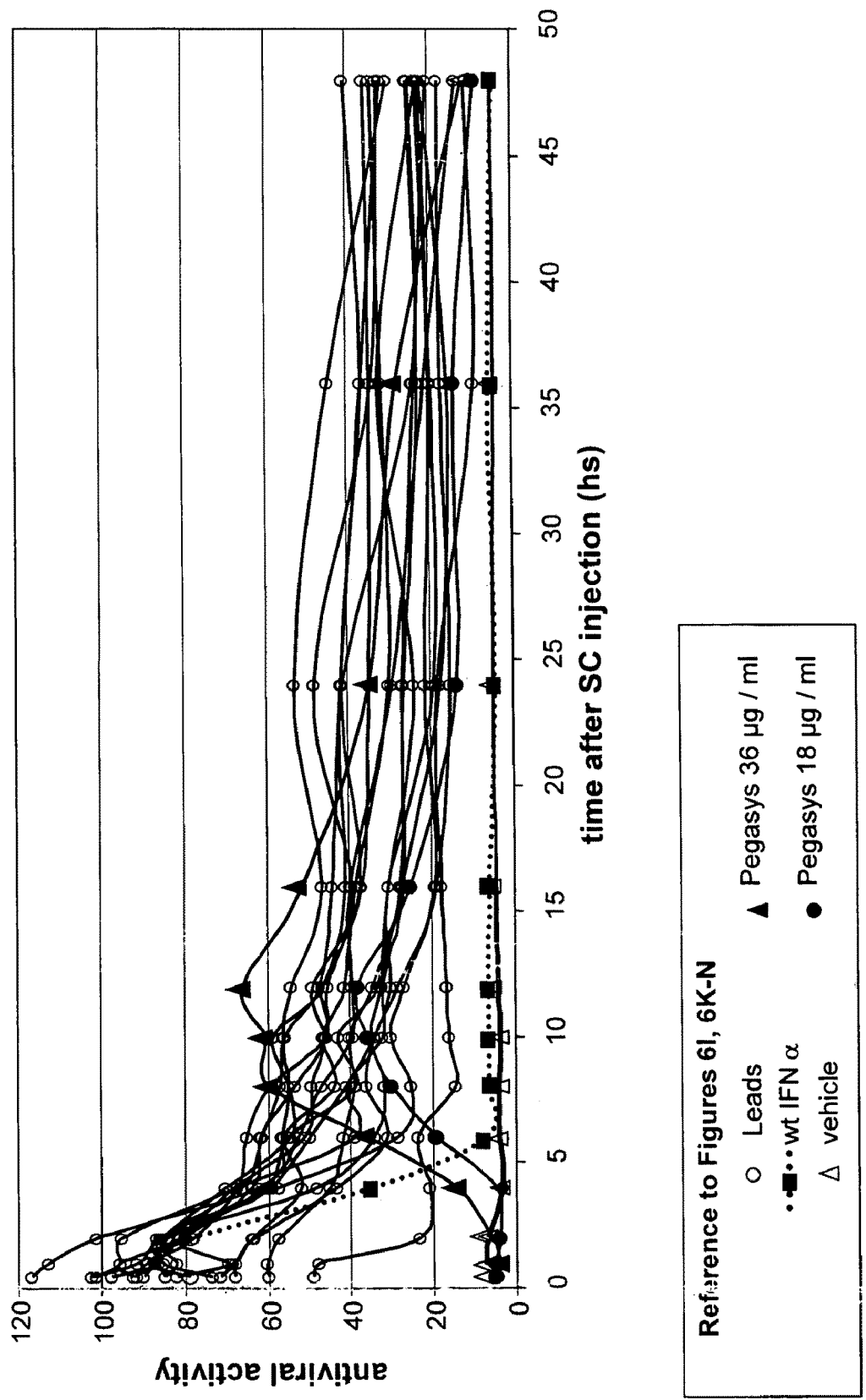
Figure 6K:
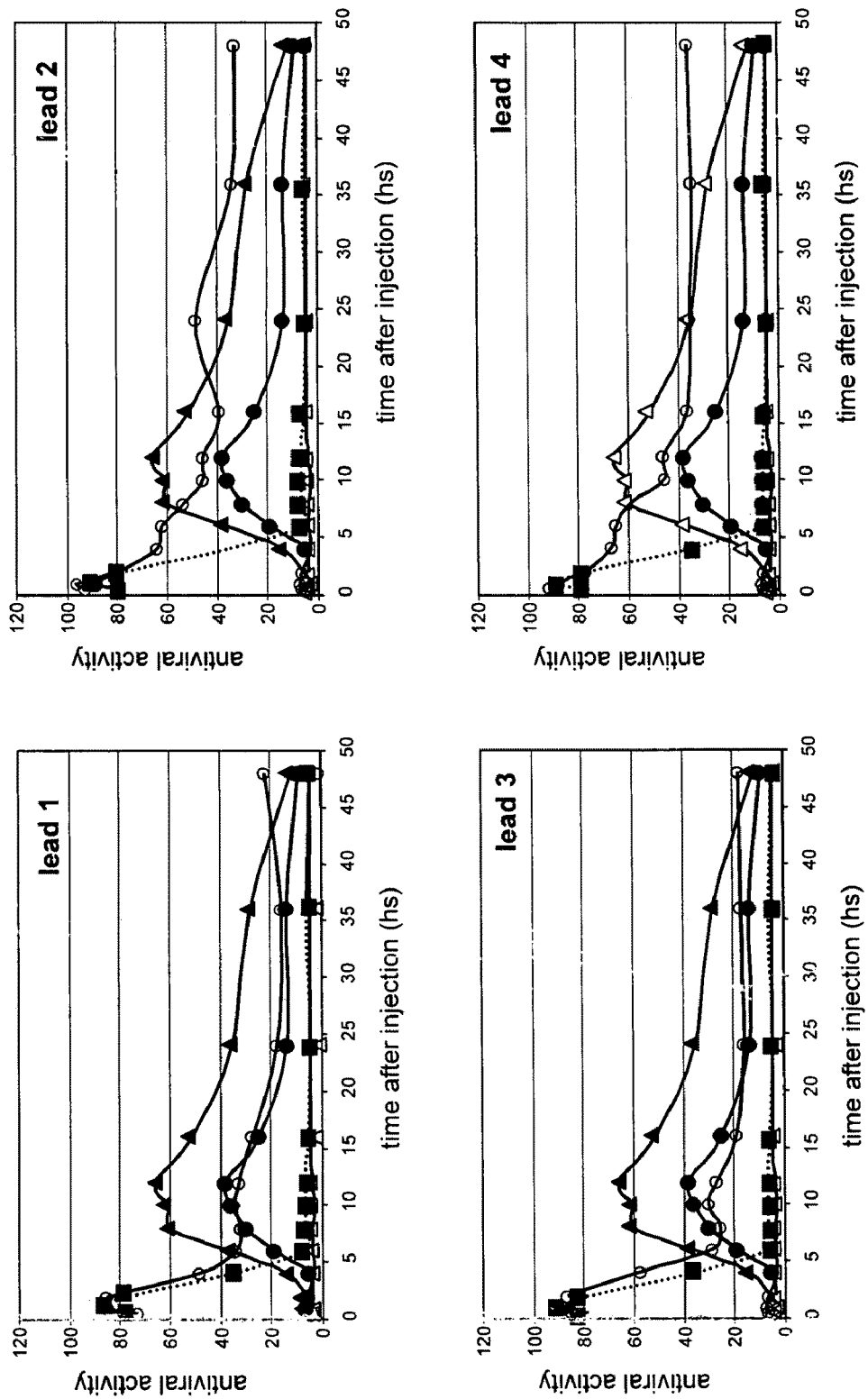
Figure 6L:
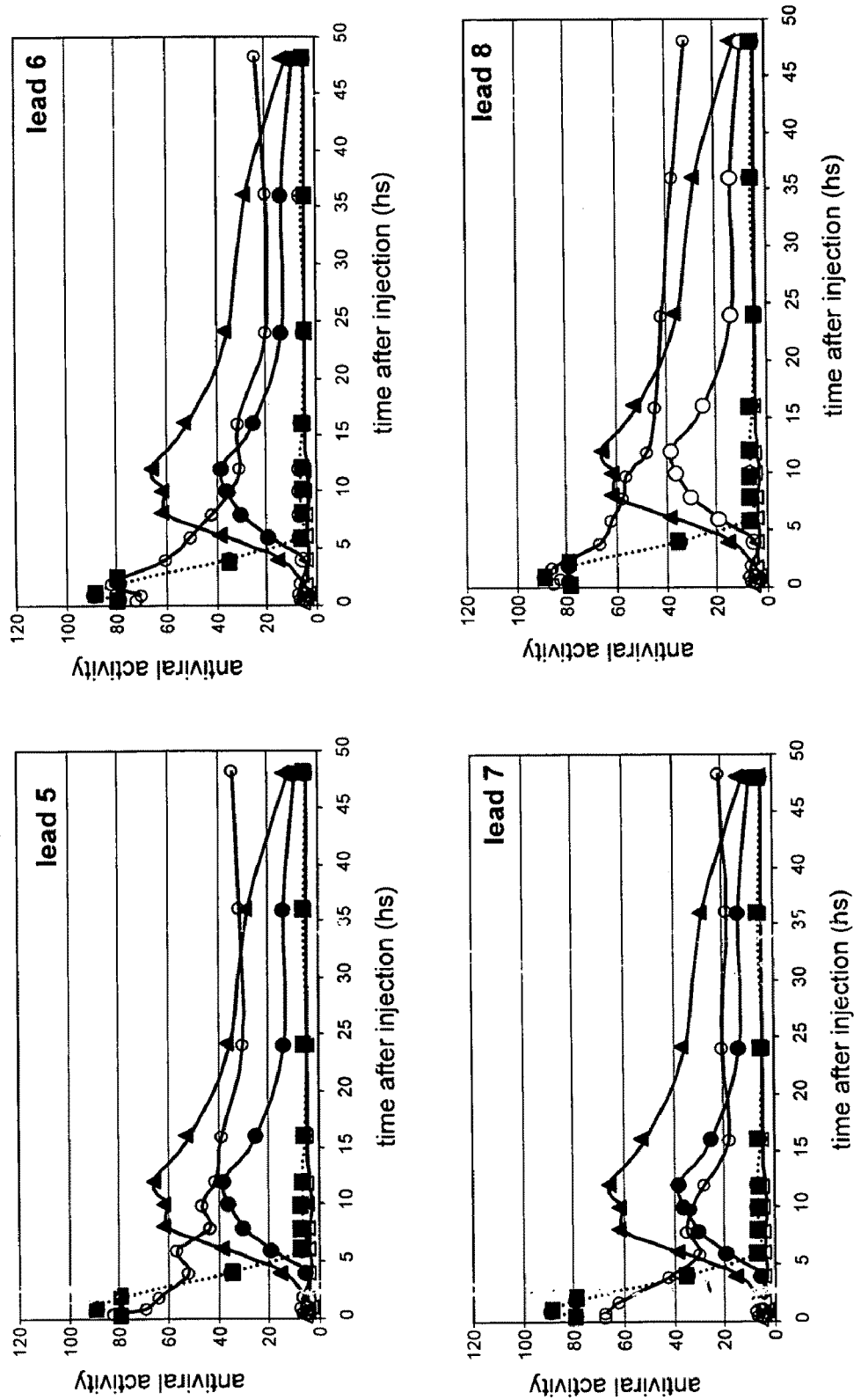
Figure 6M:
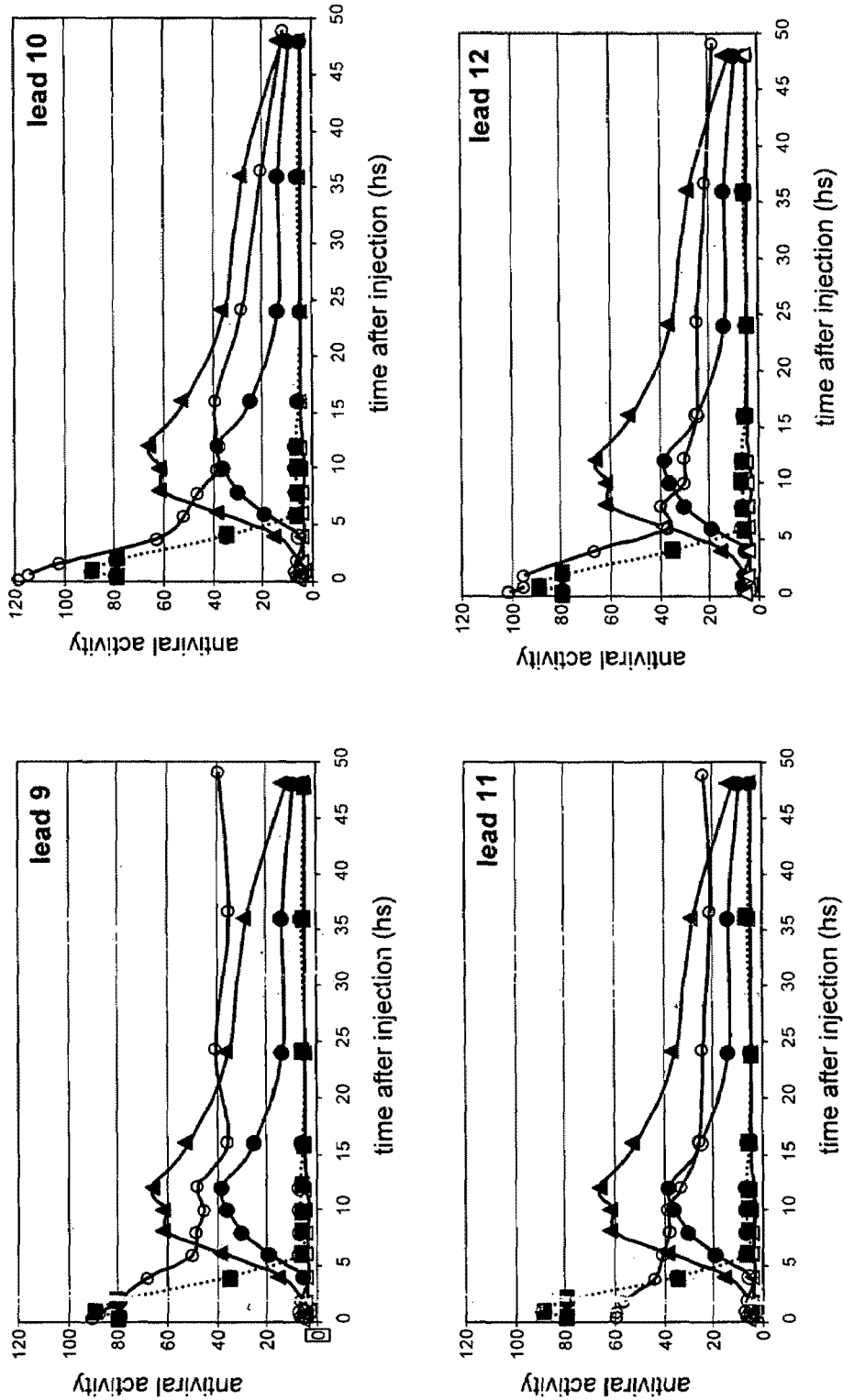
Figure 6N:
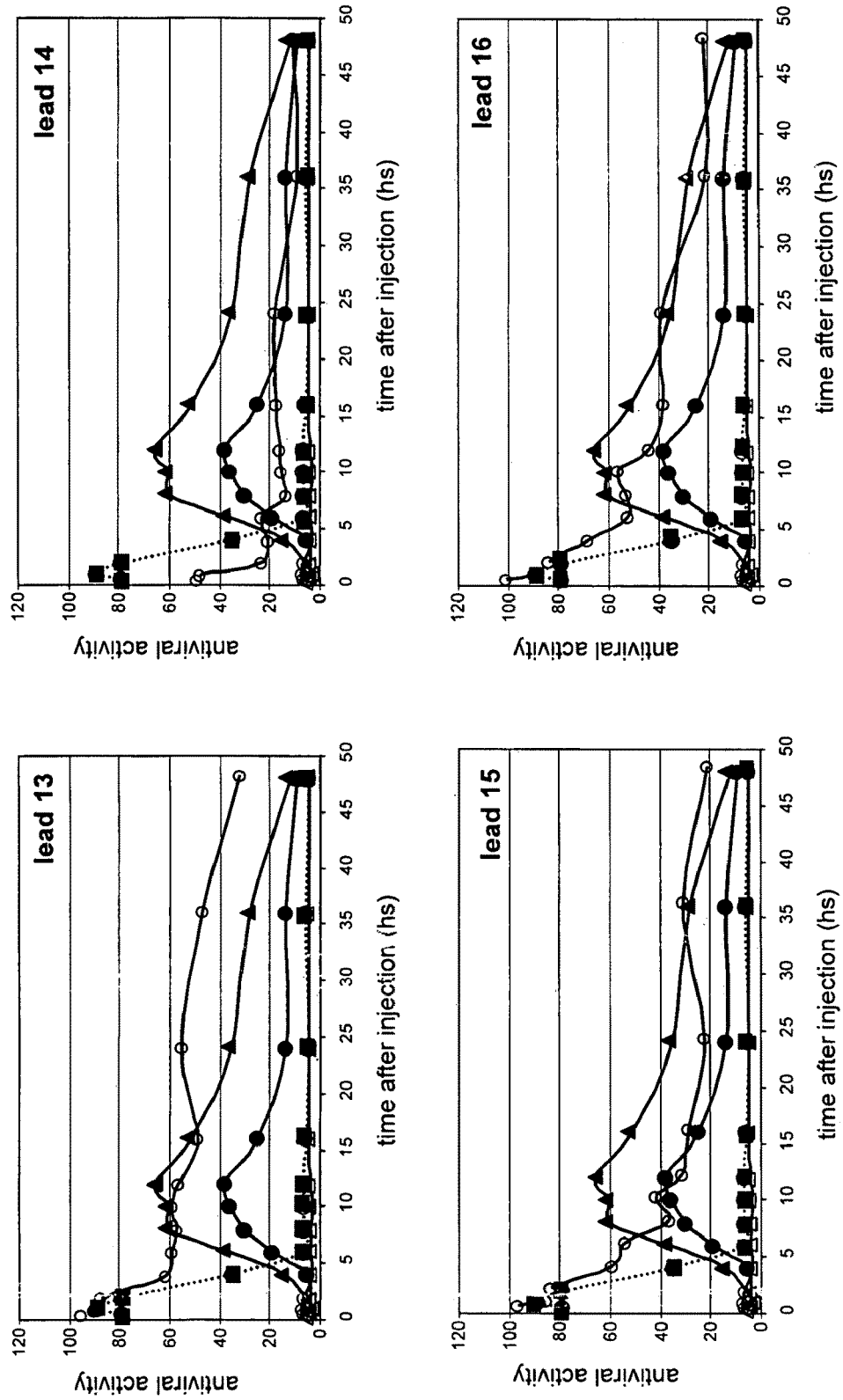
Figure 6O:
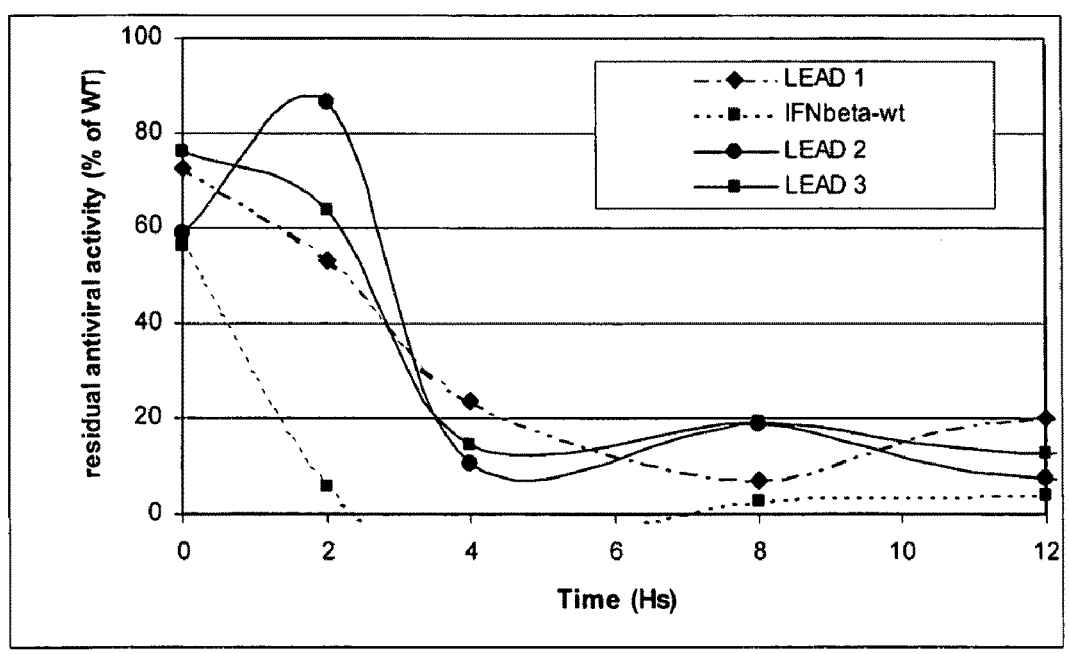
Figure 6P:
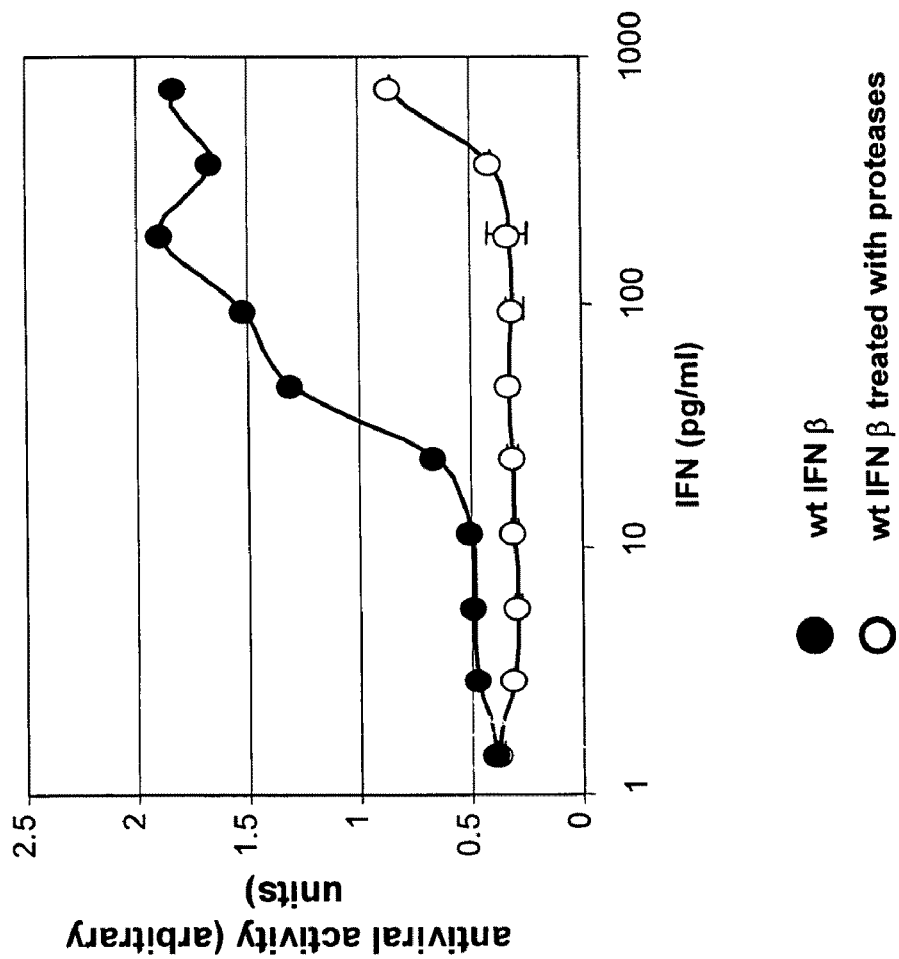
Figure 6Q:
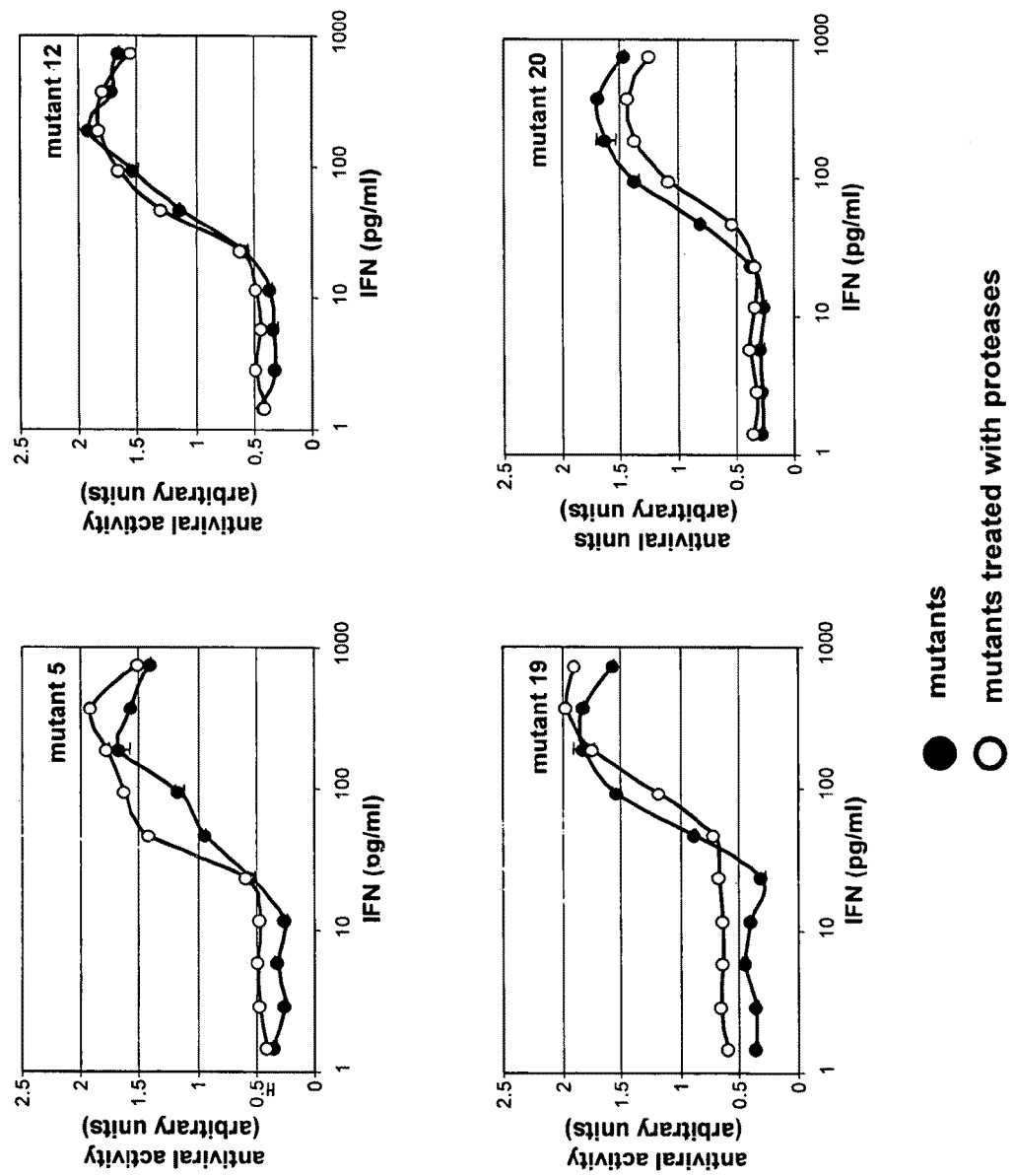
Figure 6R:
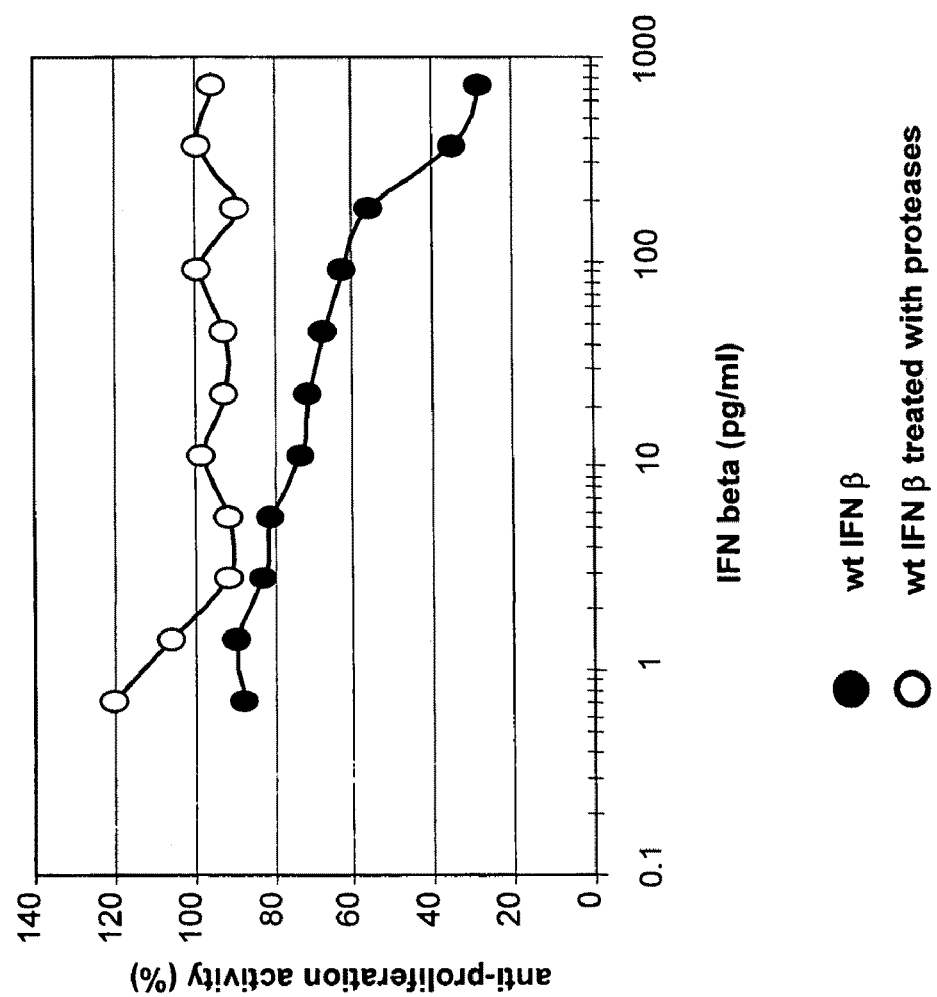
Figure 6S:
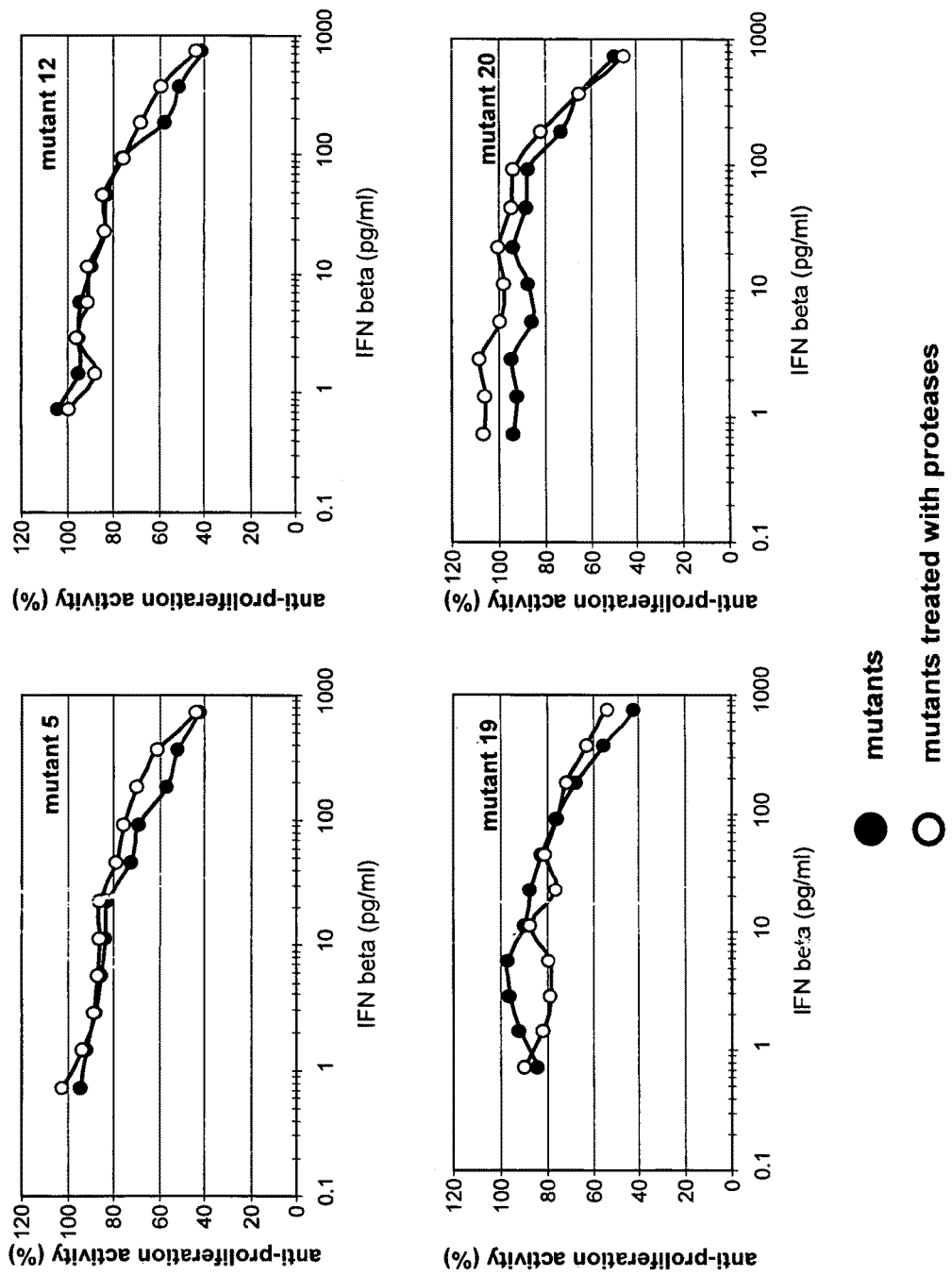
Figure 7A:
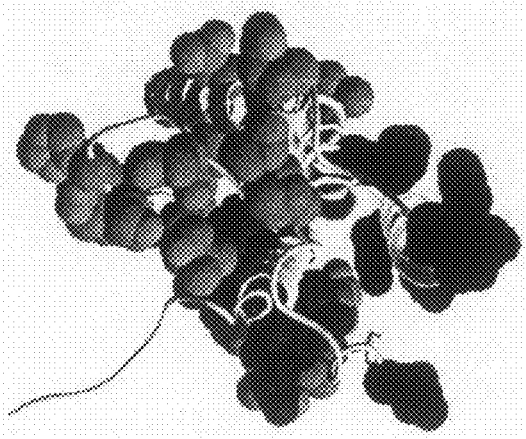
Figure 7B:
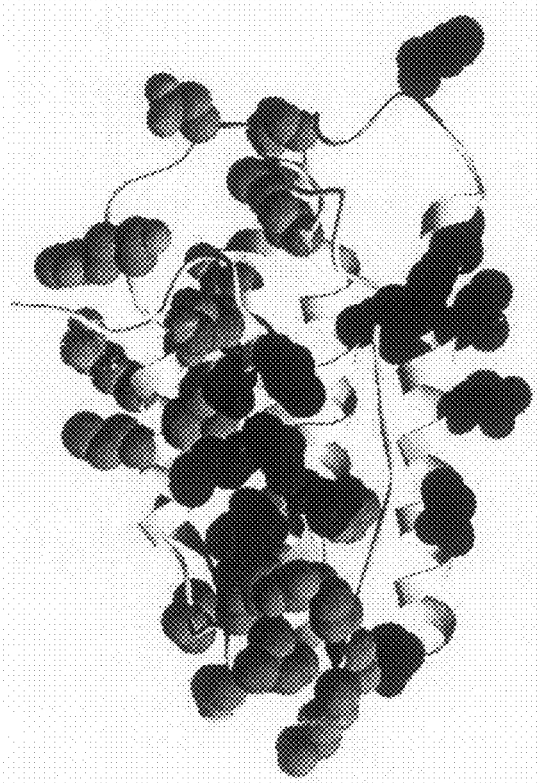

IFNα-2b mutants selected on the basis of their overall performance in vitro, were tested for pharmacokinetics in mice in order to have an indication of their half-life in blood in vivo. Mice were treated by subcutaneous (SC) injection with aliquots of each of a number of selected lead mutants. Blood was collected at increasing time points between 0.5 and 48 hours after injection. Immediately after collection, 20 ml of anti-protease solution were added to each blood sample. Serum was obtained for further analysis. Residual IFN-α activity in blood was determined using the tests described in the precedent sections for in vitro characterization. Wild-type IFN α (that had been produced in bacteria under comparable conditions as the lead mutants) as well as a pegylated derivative of IFN α, Pegasys (Roche), also were tested for pharmacokinetics in the same experiments.

Example 2

This example demonstrates the 2-dimensional (2D)scanning of IFNα-2b for increased resistance to proteolysis. For results, see FIGS. 6(A)-6(N), 6(T) and 6(U).

A) Identifying some or all possible target sites on the protein sequence that are susceptible to digestion by one or more specific proteases (these sites are the is-HITs).

Because IFNα-2b is administered as a therapeutic protein in the blood stream, a set of proteases was identified that were expected to broadly mimic the protease contents in serum. From that list of proteases, a list of the corresponding target amino acids was identified (shown in parenthesis) as follows: α-chymotrypsin (F, L, M, W, and Y), endoproteinase Arg-C (R), endoproteinase Asp-N (D), endoproteinase Glu-C (E), endoproteinase Lys-C (K), and trypsin (K and R) Carboxypeptidase Y, which cleaves non-specifically from the carboxy-terminal ends of proteins, was also included in the protease mixture. The distribution of the target amino acids over the protein sequence spreads over the complete length of the protein, suggesting that the protein is potentially sensitive to protease digestion all over its sequence (FIG. 1A). In order to restrict the number of is-HITs to a lower number of candidate positions, the 3-dimensional structure of the IFNα-2b molecule (PDB code 1RH2) was used to identify and select only those residues exposed on the surface, while discarding from the candidate list those which remain buried in the structure, and therefore stay less susceptible to proteolysis (FIG. 1B).

B) Identifying appropriate replacing amino acids, specific for each is-HIT, such that if used to replace one or more of the original, such as native, amino acids at that specific is-HIT, they can be expected to increase the is-HIT amino acid position's resistance to digestion by protease while at the same time, maintaining or improving the requisite biological activity of the protein (these replacing amino acids are the candidate LEADs).

To select the candidate replacing amino acids for each is-HIT position, PAM250 matrix based analysis was used (FIG. 2). In one embodiment, the two highest values in PAM250 matrix, corresponding to the highest occurrence of substitutions between residues ("conservative substitutions" or "accepted point mutations"), were chosen (FIG. 3). Whenever only a conservative substitution was available for a given high value of the PAM250, the following higher value was selected and the totality of conservative substitutions for this value was considered. The replacement of amino acids that are exposed on the surface by cysteine residues (as shown in FIG. 3, while replacing Y by H or I) was explicitly avoided, since this change would potentially lead to the formation of intermolecular disulfide bonds.

Thus, based on the nature of the challenging proteases, and on evolutionary considerations as well as protein structural analysis, a strategy was defined for the rational design of human IFNα-2b mutants having increased resistance to proteolysis which could produce therapeutic proteins having a longer half-life. By using the algorithm PROTEOL (see, e.g., infobiogen.fr), a list of residues along the IFNα-2b sequence was established, which can be recognized as a substrate for different enzymes present in the serum. Because the number of residues in this particular list was high, the 3-dimensional structure of IFNα-2b obtained from the NMR structure of IFNα-2a (PDB code 1ITF) was used to select only those residues exposed to the solvent. Using this approach, 42 positions were identified, which numbering is that of the mature protein (SEQ ID NO:1): L3, P4, R12, R13, M16, R22, R23, F27, L30, K31, R33, E41, K49, E58, K70, E78, K83, Y89, E96, E107, P109, L110, M111, E113, L117, R120, K121, R125, L128, K131, E132, K133, K134, Y135, P137, M148, R149, E159, L161, R162, K164, and E165. Each of these positions was replaced by amino acid residues, such that they are defined as compatible by the substitution matrix PAM250 while at the same time the replacement amino acids do not generate new sites for proteases.

The list of performed residue substitutions as determined by PAM250 analysis is as follows:
R to H, Q
E to H, Q
K to Q, T
L to V, I
M to I, V
P to A, S
Y to I, H.

C) Systematically introducing the specific replacing amino acids (candidate LEADs) at every specific is-HIT position to generate a collection containing the corresponding mutant molecules.

The individual IFNα-2b mutants are generated, produced and phenotypically characterized one-by-one, in addressable arrays as set forth in Example 1, such that each mutant molecule contains initially amino acid replacements at only one is-HIT site. LEAD positions were obtained in IFNα-2b variants after a screening for protection against proteases, and comparing protease-untreated and protease-treated variant preparations with the corresponding conditions for the wild-type IFNα-2b. The percent of residual (anti-viral) activity for the IFNα-2b E113H variant after treatment with chymotrypsin, protease mixture, blood lysate or serum was compared to the treated wild-type IFNα-2b. Selected IFNα-2b LEADs are shown in Table 2.

A top and side view of IFNα-2b structure in ribbon representation (obtained from NMR structure of IFNα-2a, PDB code 1ITF) depict residues in "space filling" defining (1) the "receptor binding region" as deduced either by "alanine scanning" data and studies by Piehler et al., *J. Biol. Chem.*, 275: 40425-40433, 2000, and Roisman et al., *Proc. Natl. Acad. Sci USA*, 98:13231-13236, 2001, and (2) replacing residues (LEADs) for resistance to proteolysis.

TABLE 2

Selected LEADs of IFNα-2b following protease resistance

| Mutant | SEQ ID No. | Proteolysis protection | IFN antiviral activity |
|---|---|---|---|
| F27V | 83 | Pseudo wt | Pseudo wt |
| R33H | 86 | Pseudo wt | Pseudo wt |
| E41Q | 87 | Increased | Increased |
| E41H | 88 | Pseudo wt | Increased |
| E58Q | 89 | Increased | Pseudo wt |
| E58H | 90 | Increased | Increased |
| E78Q | 92 | Increased | Increased |
| E78H | 93 | Increased | Increased |
| Y89H | 1303 | Pseudo wt | Pseudo wt |
| E107Q | 95 | Increased | Pseudo wt |
| E107H | 96 | Increased | Pseudo wt |
| P109A | 97 | Pseudo wt | Pseudo wt |
| L110V | 98 | Pseudo wt | Pseudo wt |
| M111V | 978 | Pseudo wt | Pseudo wt |
| E113H | 101 | Increased | Pseudo wt |
| L117V | 102 | Increased | Pseudo wt |
| L117I | 103 | Increased | Pseudo wt |
| K121Q | 104 | Increased | Pseudo wt |
| R125H | 106 | Increased | Increased |
| R125Q | 107 | Increased | Increased |
| K133Q | 114 | Increased | Increased |
| E159H | 125 | Increased | Pseudo wt |
| E159Q | 124 | Increased | Pseudo wt |

Example 3

Stabilization of IFNα-2b by Creation of N-Glycosylation Sites

The creation of N-glycosylation sites on the protein was a second strategy that was used to stabilize IFNα-2b. Natural human IFNα-2b contains a unique O-glycosylation site at position 129 (the numbering corresponds to the mature protein; SEQ ID NO:1), however, no N-glycosylation sites are found in this sequence. N-glycosylation sites are defined by the N—X—S or N—X-T consensus sequences. Glycosylation has been found to play a role in protein stability. For example, glycosylation has been found to increase bioavailability via higher metabolic stability and reduced clearance. In order to generate more stable IFNα-2b variants, the N-glycosylation consensus sequences indicated above were introduced in the IFNα-2b sequence by mutagenesis. Variants of IFNα-2b carrying new glycosylation sites were assessed as previously described.

The structure of IFNα-2b is characterized by a helix bundle composed of 5 helices (A, B, C, D and E) connected with each other by a series of loops (a large AB loop and three shorter BC, CD, DE loops). The helices are joined together by two disulfide bridges between residues 1/98 and 29/138 of SEQ ID NO:1. The loops are contemplated herein to represent preferential sites for glycosylation given their exposure. Therefore, N-glycosylation sites (N—X—S or N—X-T) were created in each of the loop sequences (Table 3). Selected LEADs and pseudo wild-type IFNα-2b mutants after screening for addition of glycosylation sites are shown in Table 4.

TABLE 3

In silico HITs for addition of glycosylation sites on IFNα-2b

| Codon No. | SEQ ID No. | N-X-S | SEQ ID No. | N-X-T |
|---|---|---|---|---|
| c2-4 | | D2N/P4S | | D2N/P4T |
| c3-5 | | L3N/Q5S | | L3N/Q5T |
| c4-6 | | P4N/T6S | | P4N/T6T |
| c5-7 | 127 | Q5N/H7S | 128 | Q5N/H7T |
| c6-8 | 129 | T6N/S8S | | T6N/S8T |
| c7-9 | | H7N/L9S | | H7N/L9T |
| c8-10 | 130 | S8N/G10S | 131 | S8N/G10T |
| c9-11 | | L9N/S11S | | L9N/S11T |
| c10-12 | 132 | M21N/R23S | | M21N/R23T |
| c22-24 | | R22N/I24S | | R22N/I24T |
| c23-25 | | R23N/S25S | 133 | R23N/S25T |
| c24-26 | 134 | I24N/L26S | | I24N/L26T |
| c25-27 | 135 | S25N/F27S | 136 | S25N/F27T |
| c26-28 | 137 | L26N/S28S | 138 | L26N/S28T |
| c28-30 | | S28N/L30S | | S28N/L30T |
| c30-32 | 139 | L30N/D32S | | L30N/D32T |
| c31-33 | | K31N/R33S | | K31N/R33T |
| c32-34 | | D32N/H34S | | D32N/H34T |
| c33-35 | 140 | R33N/D35S | 141 | R33N/D35T |
| c34-36 | 142 | H34N/F36S | 143 | H34N/F36T |
| c35-37 | 144 | D35N/G37S | | D35N/G37T |
| c36-38 | 145 | F36N/F38S | 146 | F36N/F38T |
| c37-39 | | G37N/P39S | 147 | G37N/P39T |
| c38-40 | 148 | F38N/Q40S | 149 | F38N/Q40T |
| c39-41 | 150 | P39N/E41S | 151 | P39N/E41T |
| c40-42 | 152 | Q40N/E42S | 153 | Q40N/E42T |
| c41-43 | | E41N/F43S | 155 | E41N/F43T |
| c42-44 | | E42N/G44S | | E42N/G44T |
| c43-45 | | F43N/N45S | | F43N/N45T |
| c44-46 | 156 | G44N/Q46S | 157 | G44N/Q46T |
| c45-47 | 158 | N45N/F47S | 159 | N45N/F47T |
| c46-48 | 160 | Q46N/Q48S | 161 | Q46N/Q48T |
| c47-49 | 162 | F47N/K49S | 163 | F47N/K49T |
| c48-50 | | Q48N/A50S | | Q48N/A50T |
| c49-51 | 164 | K49N/E51S | | K49N/E51T |
| c50-52 | | A50N/T52S | | A50N/T52T |
| c68-70 | | S68N/K70S | | S68N/K70T |
| c70-72 | | K70N/S72S | | K70N/S72T |
| c75-77 | 165 | A75N/D77S | | A75N/D77T |
| c77-79 | | D77N/T79S | | D77N/T79T |
| C100-102 | 166 | I100N/G102S | 167 | I100N/G102T |
| C101-103 | | Q101N/V103S | | Q101N/V103T |
| C102-104 | | G102N/G104S | | G102N/G104T |
| C103-105 | 168 | V103N/V105S | 169 | V103N/V105T |
| C104-106 | | G104N/T106S | 170 | G104N/T106T |
| C105-107 | 171 | V105N/E107S | | V105N/E107T |
| C10--108 | 172 | T106N/T108S | 173 | T106N/T108T |
| C107-109 | 174 | E107N/P109S | 175 | E107N/P109T |
| C108-110 | | T108N/I110S | | T108N/I110T |
| C134-136 | | K134N/S136S | 176 | K134N/S136T |
| C154-156 | | S154N/N156S | | S154N/N156T |
| C155-157 | | T155N/L157S | | T155N/L157T |
| C156-158 | | N156N/Q158S | | N156N/Q158T |
| C157-159 | 177 | L157N/E159S | 178 | L157N/E159T |
| C158-160 | | Q158N/S160S | 179 | Q158N/S160T |
| C159-161 | 180 | E159N/L161S | 181 | E159N/L161T |
| C160-162 | | S160N/R162S | | S160N/R162T |
| C161-163 | | L161N/S163S | | L161N/S163T |
| C162-164 | | R162N/K164S | | R162N/K164T |
| C163-165 | | S163N/E165S | | S163N/E165T |

TABLE 4

Selected LEADs and pseudo wild-type IFNα-2b mutants after screening for addition of glycosylation sites

| Mutant | SEQ ID No. | Proteolysis protection | IFN antiviral activity |
|---|---|---|---|
| Q5N/H7S | 127 | Increased | Pseudo wt |
| Q5N/H7T | 128 | ND* | ND |
| P39N/E41S | 150 | Increased | Pseudo wt |
| P39N/E41T | 151 | Increased | Pseudo wt |
| Q40N/E42S | 152 | Increased | Pseudo wt |
| Q40N/E42T | 153 | Increased | Pseudo wt |
| E41N/F43S | 154 | Increased | Pseudo wt |
| E41N/F43T | 155 | Increased | Pseudo wt |
| F43N/N45S | | Increased | Pseudo wt |
| F43N/N45T | | ND | ND |
| G44N/Q46S | 156 | ND | ND |
| G44N/Q46T | 157 | Increased | Pseudo wt |
| N45N/F47S | 158 | Increased | Pseudo wt |
| N45N/F47T | 159 | Increased | Pseudo wt |
| Q46N/Q48S | 160 | Increased | Pseudo wt |
| Q46N/Q48T | 161 | ND | ND |
| F47N/K49S | 162 | Increased | Pseudo wt |
| F47N/K49T | 163 | Increased | Pseudo wt |
| I100N/G102S | 166 | Pseudo wt | Increased |
| I100N/G102T | 167 | Pseudo wt | Increased |
| V105N/E107S | 171 | Pseudo wt | Increased |
| V105N/E107T | | Pseudo wt | Increased |
| T106N/T108S | 172 | Pseudo wt | Increased |
| T106N/T108T | 173 | Pseudo wt | Increased |
| E107N/P109S | 174 | Pseudo wt | Increased |
| E107N/P109T | 175 | Pseudo wt | Increased |
| L157N/E159S | 177 | Pseudo wt | Increased |
| L157N/E159T | 178 | Pseudo wt | Increased |
| E159N/L161S | 180 | Pseudo wt | Increased |
| E159N/L161T | 181 | Pseudo wt | Increased |

*ND, not determined

Example 4

Redesign of Interferon α-2b Proteins

The use of the protein redesign approach provided herein permits the generation of proteins such that they maintain requisite levels and types of biological activity compared to the native protein while their underlying amino acid sequences have been significantly changed by amino acid replacement. To first identify those amino acid positions on the IFNα-2b protein that are involved or not involved IFNα-2b protein activity, such as binding activity of IFNα-2b to its receptor, an Ala-scan was performed on the IFNα-2b sequence. For this purpose, each amino acid in the IFNα-2b protein sequence was individually changed into Alanine. Any other amino acid, particularly another amino acid that has a neutral effect on structure, such as Gly or Ser, also can be used. Each resulting mutant IFNα-2b protein was then expressed and the antiviral activity of the individual mutants was assayed. The particular amino acid positions that are sensitive to replacement by Ala, referred to herein as HITs would in principle not be suitable targets for amino acid replacement to increase protein stability, because of their involvement in the activity of the molecule. For the Ala-scanning, the biological activity measured for the IFNα-2b molecules was: i) their capacity to inhibit virus replication when added to permissive cells previously infected with the appropriate virus and, ii) their capacity to stimulate cell proliferation when added to the appropriate cells. The relative activity of each individual mutant compared to the native protein was assayed. HITS are those mutants that produce a decrease in the activity of the protein (e.g., in this example, all the mutants with activities below about 30% of the native activity).

In addition, to identify the HIT positions, the Alanine-scan was used to identify the amino acid residues on IFNα-2b that when replaced with alanine lead to a 'pseudo-wild type' activity, i.e., those that can be replaced by alanine without leading to a decrease in biological activity.

A collection of mutant molecules was generated and phenotypically characterized such that IFNα-2b proteins with amino acid sequences different from the native ones but that still elicit the same level and type of activity as the native protein were selected. HITs and pseudo wild-type amino acid positions are shown in Table 5.

TABLE 5

HITs and pseudo wild-type positions to IFNα-2b redesign

| Mutants | SEQ ID No. | HITs (viral activity) | Pseudo wt (viral activity) |
|---|---|---|---|
| D2A | 2 | Decreased | |
| P4A | 3 | | Pseudo wt |
| Q5A | 4 | | Pseudo wt |
| T6A | 5 | | Pseudo wt |
| H7A | 6 | Decreased | |
| S8A | 7 | Decreased | |
| L9A | 8 | | Pseudo wt |
| G10A | 9 | | Pseudo wt |
| S11A | 10 | Decreased | |
| R12A | 11 | Decreased | |
| R13A | 12 | Decreased | |
| T14A | 13 | Decreased | |
| L15A | 14 | Decreased | |
| M16A | 15 | Decreased | |
| L17A | 16 | | Pseudo wt |
| Q20A | 17 | | Pseudo wt |
| R23A | 18 | Decreased | |
| I24A | 19 | | Pseudo wt |
| S25A | 20 | | Pseudo wt |
| L26A | 21 | Decreased | |
| S28A | 22 | Decreased | |
| C29A | 23 | Decreased | |
| L30A | 24 | Decreased | |
| K31A | 25 | Decreased | |
| D32A | 26 | Decreased | |
| R33A | 27 | Decreased | |
| D35A | 28 | | Pseudo wt |
| G37A | 29 | | Pseudo wt |
| G39A | 30 | | Pseudo wt |
| E41A | 31 | | Pseudo wt |
| E42A | 32 | | Pseudo wt |
| F43A | 33 | Decreased | |
| N45A | 34 | Decreased | |
| F47A | 35 | Decreased | |
| E51A | 36 | | Pseudo wt |
| T52A | 37 | | Pseudo wt |
| I53A | 38 | Decreased | |
| P54A | 39 | | Pseudo wt |
| V55A | 40 | | Pseudo wt |
| L56A | 41 | | Pseudo wt |
| H57A | 42 | | Pseudo wt |
| E58A | 43 | | Pseudo wt |
| M59A | 44 | Decreased | |
| I60A | 45 | | Pseudo wt |
| I63A | 46 | | Pseudo wt |
| F64A | 47 | | Pseudo wt |
| N65A | 48 | | Pseudo wt |
| L66A | 49 | Decreased | |
| F67A | 50 | Decreased | |
| T69A | 51 | Decreased | |
| K70A | 52 | Decreased | |
| D71A | 53 | Decreased | |
| S72A | 54 | Decreased | |
| W76A | 55 | | Pseudo wt |
| D77A | 56 | | Pseudo wt |
| E78A | 57 | | Pseudo wt |

TABLE 5-continued

HITs and pseudo wild-type positions to IFNα-2b redesign

| Mutants | SEQ ID No. | HITs (viral activity) | Pseudo wt (viral activity) |
|---|---|---|---|
| L81A | 58 | | Pseudo wt |
| D82A | 59 | Decreased | |
| K83A | 60 | Decreased | |
| F84A | 61 | Decreased | |
| Y85A | 62 | | Pseudo wt |
| Y89A | 63 | | Pseudo wt |
| Q90A | 64 | | Pseudo wt |
| Q91A | 65 | Decreased | |
| N93A | 66 | Decreased | |
| D94A | 67 | Decreased | |
| C98A | 68 | Decreased | |
| V99A | 69 | Decreased | |
| Q101A | | Decreased | |
| G104A | 70 | | Pseudo wt |
| L110A | 71 | | Pseudo wt |
| S115A | 72 | | Pseudo wt |
| Y122A | 73 | Decreased | |
| W140A | 74 | Decreased | |
| E146A | 75 | | Pseudo wt |

Example 5

Super LEADS of Interferon α-2b Protein by Additive Directional Mutagenesis

The use of an additive directional mutagenesis approach provided a method for the assembly of multiple mutations previously present on the individual LEAD molecules in a single mutant protein thereby generating super-LEAD mutant proteins. In this method, a collection of nucleic acid molecules encoding a library of new mutant molecules is generated, tested and phenotypically characterized one-by-one in addressable arrays. Super-LEAD mutant molecules are such that each molecule contains a variable number and type of LEAD mutations Using the LEADs obtained in Example 2, six series of mutant molecules were generated with more than one mutation per molecule as shown in Table 6. Some SuperLEAD mutant molecules were phenotypically characterized and the results are shown in Table 7. As shown in the table not all SuperLEADS have improved activity compared with the original Leads; some showed decreased activity of some type.

TABLE 6

| Schema of LEADs position for SuperLEADS generation |
|---|
| Series 1 |
| m1 = E41H |
| m1 + m2 = E41H + Y89H |
| Series 2 |
| m1 = E58Q |
| m1 + m2 = E58Q + F27V |
| Series 3 |
| m1 = R125H |
| m1 + m2 = R125H + M111V |
| Series 4 |
| m1 = E159H |
| m1 + m2 = E159H + Y89H |

TABLE 6-continued

| Schema of LEADs position for SuperLEADS generation |
|---|
| Series 5 |
| m1 = K121Q |
| m1 + m2 = K121Q + P109A |
| m1 + m2 + m3 = K121Q + P109A + K133Q |
| Series 6 |
| m1 = E78H |
| m1 + m2 = E78H + R33H |
| m1 + m2 + m3 = E78H + R33H + E58H |
| m1 + m2 + m3 + m4 = E78H + R33H + E58H + L11OV |

TABLE 7

SuperLEADs of IFNα-2b multiple mutants

| Mutant | SEQ ID No. | Proteolysis protection | IFN antiviral activity |
|---|---|---|---|
| E41H | 88 | Pseudo wt | Increased |
| Y89H | 1303 | Pseudo wt | Pseudo wt |
| E41H/Y89H/N45D | 979 | Increased | Increased |
| E58Q | 89 | Increased | Pseudo wt |
| F27V | 83 | Pseudo wt | Pseudo wt |
| E58Q/F27V | 981 | Increased | Pseudo wt |
| R125H | 106 | Increased | Increased |
| M111V | 978 | Pseudo wt | Pseudo wt |
| R125H/M111V | 986 | Increased | Increased |
| E159H | 125 | | |
| Y89H | 1303 | | |
| E159H/Y89H | 987 | | |
| K121Q | 104 | Increased | Pseudo wt |
| P109A | 97 | Pseudo wt | Pseudo wt |
| K133Q | 114 | Increased | Increased |
| K121Q/P109A | 983 | Increased | Pseudo wt |
| K121Q/P109A/ K133Q/G102R | 984 | Increased | Increased |
| E78H | 93 | Increased | Increased |
| R33H | 86 | Pseudo wt | Pseudo wt |
| E58H | 90 | Increased | Increased |
| L110V | 98 | Pseudo wt | Pseudo wt |
| E78H/R33H/ E58H/L110V | 982 | Decreased | Decreased |

Four mutants with mutations in addition to those selected by the rational mutagenesis were generated in the *E. coli* MutS strain and were detected by sequencing. The mutants were the following: E41Q/D94G; L117V/A139G; E41H/Y89H/N45D; and K121Q/P109A/K133Q/G102R.

Example 6

Cloning of IFNβ in pNAUT, a Mammalian Cell Expression Plasmid

The cDNA encoding IFN β (see, SEQ ID No. 196) was cloned into a mammalian expression vector, prior to the generation of the selected mutations (see, FIGS. 6(O)-6(S) and 8(A). A collected of predesigned, targeted mutants was then generated such that each individual mutant was created and processed individually, physically separated form each other and in addressable arrays. The mammalian expression vector pSSV9 CMV 0.3 pA (see, Example 1) was engineered as follows:

The pSSV9 CMV 0.3 pA was cut by PvuII and religated (this step gets rid of the ITR functions), prior to the introduction of a new EcoRI restriction site by Quickchange mutagenesis (Stratagene). The oligonucleotide sequences used, follow:

```
EcoRI forward primer:
5'-GCCTGTATGATTTATTGGATGTTGGAATTCC (SEQ ID NO: 218)
CTGATGCGGTATTTTCTCCTTACG-3'

EcoRI reverse prime:
5'-CGTAAGGAGAAAATACCGCATCAGGGAATTC (SEQ ID NO: 219)
CAACATCCAATAAATCATACAGGC-3'
```

The construct sequence was confirmed by using the following oligonucleotides:

```
Seq ClaI forward primer:
5'-CTGATTATCAACCGGGGTACATATGATTGAC (SEQ ID NO: 220)
ATGC-3'

Seq XmnI reverse primer
5'-TACGGGATAATACCGCGCCACATAGCAGAA  (SEQ ID NO: 221)
C-3'.
```

Then, the XmnI-ClaI fragment containing the newly introduced EcoRI site was cloned into pSSV9 CMV 0.3 pA to replace the corresponding wild-type fragment and produce construct pSSV9-2EcoRI.

The IFN β-cDNA was obtained from the pIFNβ1 (ATCC) construct. The sequence of the IFN β-cDNA was confirmed by sequencing using the primers below:

```
Seq forward primer:
5'-CCTGATGAAGGAGGACTC-3'     (SEQ ID NO: 222)

Seq reverse primer:
5'-CCAAGCAGCAGATGAGTC-3'.    (SEQ ID NO: 223)
```

The verified IFN β-encoding cDNA first was cloned into the pTOPO-TA vector (Invitrogen). After checking of the cDNA sequence by automatic DNA sequencing, the HindIII-XbaI fragment containing the IFN cDNA was subcloned into the corresponding sites of pSSV9-2EcoRI, leading to the construct pAAV-EcoRI-IFNbeta (pNB-AAV-IFN beta) Finally the fragment Pvu II of plasmid pNB-AAV-IFN beta was subcloned in PvuII site of pUC 18 leading the final construct pUC-CMVIFNbetapA called pNAUT-IFNbeta.

Production and Normalization of IFNβ in Mammalian Cells

IFN β was produced in CHO Chinese Hamster Ovarian cells (obtained from ATCC), using Dulbecco's modified Eagle's medium supplemented with glucose (4.5 g/L; Gibco-BRL) and fetal bovine serum (5%, Hyclone). Cells were transiently transfected as follows: $0.6\times10^5$ cells were seeded into 6 well plates and grown for 24 h before transfection. Confluent cells at about 70%, were supplemented with 1.0 μg of plasmid (from the library of IFN β mutants) by Lipofectamine Plus reagent (Invitrogen). After gently shaking, cells were incubated for 24 h with 1 ml of culture medium supplemented with 1% of serum. IFN β was obtained from culture supernatants 24 h after transfection and stored in aliquots at −80° C. until use.

Preparations of IFN β produced from transfected cells were screened following sequential biological assays as follows. Normalization of IFN β concentration from culture supernatants was performed by ELISA. IFN β concentrations from wild type, and mutant samples were estimated by using an international reference standard provided by the NIBSC, UK.

Screening and In Vitro Characterization of IFN β Mutants

Two activities were measured directly on IFN samples: antiviral and antiproliferation activities. Dose (concentration)-response (activity) experiments for antiviral or antiproliferation activity allowed for the calculation of the "potency" for antiviral and antiproliferation activities, respectively. Antiviral and antiproliferation activities also were measured after incubation with proteolytic samples such as specific proteases, mixtures of selected proteases, human serum or human blood. Assessment of activity following incubation with proteolytic samples allowed to determine the residual (antiviral or antiproliferation) activity and the respective kinetics of half-life upon exposure to proteases.

Antiviral Activity-Measured by Cytopathic Effects (CPE)

Antiviral activity of IFN β was determined by the capacity of the cytokine to protect HeLa cells against EMC (mouse encephalomyocarditis) virus-induced cytopathic effects. The day before, HeLa cells ($2 \times 10^5$ cells/ml) were seeded in flat-bottomed 96-well plates containing 100 µl/well of Dulbecco's MEM-GlutamaxI-sodium pyruvate medium supplemented with 5% SVF and 0.2% of gentamicin. Cells were growth at 37° C. in an atmosphere of 5% $CO_2$ for 24 hours.

Two-fold serial dilutions of interferon samples were made with MEM complete media into 96-Deep-Well plates with final concentration ranging from 1600 to 0.6 pg/ml. The medium was aspirated from each well and 100 µl of interferon dilutions were added to HeLa cells. Each interferon sample dilution was assessed in triplicate. The two last rows of the plates were filled with 100 µl of medium without interferon dilution samples in order to serve as controls for cells with and without virus.

After 24 hours of growth, a 1/1000 EMC virus dilution solution was placed in each well, except for the cell control row. Plates were returned to the $CO_2$ incubator for 48 hours. Then, the medium was aspirated and the cells were stained for 1 hour with 100 µl of Blue staining solution to determine the proportion of intact cells. Plates were washed in a distilled water bath. The cell bound dye was extracted using 100 µl of ethylene-glycol mono-ethyl-ether (Sigma). The absorbance of the dye was measured using an Elisa plate reader (Spectramax). The antiviral activity of IFN β samples (expressed as number of IU/mg of proteins) was determined as the concentration needed for 50% protection of the cells against EMC virus-induced cytopathic effects. For proteolysis experiments, each point of the kinetic was assessed at 800 and 400 pg/ml in triplicate.

Anti-Proliferative Activity

Anti-proliferative activity of IFN β was determined by assessing the capacity of the cytokine to inhibit proliferation of Daudi cells. Daudi cells ($1 \times 10^4$ cells) were seeded in flat-bottomed 96-well plates containing 50 µl/well of RPMI 1640 medium supplemented with 10% SVF, 1× glutamine and 1 ml of gentamicin. No cell was added to the last row ("H" row) of the flat-bottomed 96-well plates in order to evaluate background absorbance of culture medium.

At the same time, two-fold serial dilutions of interferon samples were made with RPMI 1640 complete media into 96-Deep-Well plates with final concentration ranging from 6000 to 2.9 pg/ml. Interferon dilutions (50 µl) were added to each well containing 50 µl of Daudi cells. The total volume in each well should now be 100 µl. Each interferon sample dilution was assessed in triplicate. Each well of the "G" row of the plates was filled with 50 µl of RPMI 1640 complete media in order to be used as positive control. The plates were incubated for 72 hours at 37° C. in a humidified, 5% $CO_2$ atmosphere.

After 72 hours of growth, 20 µl of Cell titer 96 Aqueous one solution reagent (Promega) was added to each well and incubated 1H30 at 37° C. in an atmosphere of 5% $CO_2$. To measure the amount of colored soluble formazan produced by cellular reduction of the MTS, the absorbance of the dye was measured using an Elisa plate reader (Spectramax) at 490 nm.

The corrected absorbances ("H" row background value subtracted) obtained at 490 nm were plotted versus concentration of cytokine. The ED50 value was calculated by determining the X-axis value corresponding to one-half the difference between the maximum and minimum absorbance values. (ED50=the concentration of cytokine necessary to give one-half the maximum response).

Treatment of IFN β with Proteolytic Preparations

Mutants were treated with proteases in order to identify resistant molecules. The resistance of the mutant IFN β molecules compared to wild-type IFN β against enzymatic cleavage (120 min, 25° C.) by a mixture of proteases (containing 1.5 pg of each of the following proteases (1% wt/wt, Sigma): α-chymotrypsin, carboxypeptidase, endoproteinase Arg-C, endoproteinase Asp-N, endoproteinase Glu-C, endoproteinase Lys-C, and trypsin) was determined. At the end of the incubation time, 10 μl of anti-proteases complete, mini EDTA free, Roche (one tablet was dissolved in 10 ml of DMEM and then diluted to 1/1000) was added to each reaction in order to inhibit protease activity. Treated samples were then used to determine residual antiviral or antiproliferation activities.

Protease Resistance—Kinetic Analysis

The percent of residual IFN β activity over time of exposure to proteases was evaluated by a kinetic study using 1.5 pg of protease mixture. Incubation times were: 0 h, 0.5 h, 2 h, 4 h, 8 h, 12 h, 24 h and 48 h. Briefly, 20 μl of each proteolytic sample (proteases, serum, blood) was added to 100 μl of IFN β at 400 and 800 pg/ml and incubated for variable times, as indicated. At the appropriate time points, 10 μl of anti-proteases mixture, mini EDTA free, Roche (one tablet was dissolved in 10 ml of DMEM and then diluted to 1/500) was added to each well in order to stop proteolysis reactions. Biological activity assays were then performed as described for each sample in order to determine the residual activity at each time point.

Performance

The various biological activities, protease resistance and potency of each individual mutant were analyzed using a mathematical model and algorithm (NautScan™; Fr. Patent No. 9915884; see, also published International PCT application No. WO 01/44809 based on PCT no PCT/FR00/03503). Data was processed using a Hill equation-based model that uses key feature indicators of the performance of each individual mutant. Mutants were ranked based on the values of their individual performance and those on the top of the ranking list were selected as leads.

Using the 2D-scanning and 3D-scanning methods described above in addition to the 3-dimensional structure of IFNβ, the following amino acid target positions were identified as is-HITs on IFNβ, which numbering is that of the mature protein (SEQ ID NO:196):

By 3D-scanning (see, SEQ ID Nos. 234-289, 989-1015): D by Q at position 39, D by H at position 39, D by G at position 39, E by Q at position 42, E by H at position 42, K by Q at position 45, K by T at position 45, K by S at position 45, K by H at position 45, L by V at position 47, L by I at position 47, L by T at position 47, L by Q at position 47, L by H at position 47, L by A at position 47, K by Q at position 52, K by T at position 52, K by S at position 52, K by H at position 52, F by I at position 67, F by V at position 67, R by H at position 71, R by Q at position 71, D by H at position 73, D by G at position 73, D by Q at position 73, E by Q at position 81, E by H at position 81, E by Q at position 107, E by H at position 107, K by Q at position 108, K by T at position 108, K by S at position 108, K by H at position 108, E by Q at position 109, E by H at position 109, D by Q at position 110, D by H at position 110, D by G at position 110, F by I at position 111, F by V at position 111, R by H at position 113, R by Q at position 113, L by V at position 116, L by I at position 116, L by T at position 116, L by Q at position 116, L by H at position 116, L by A at position 116, L by V at position 120, L by I at position 120, L by T at position 120, L by Q at position 120, L by H at position 120, L by A at position 120, K by Q at position 123, K by T at position 123, K by S at position 123, K by H at position 123, R by H at position 124, R by Q at position 124, R by H at position 128, R by Q at position 128, L by V at position 130, L by I at position 130, L by T at position 130, L by Q at position 130, L by H at position 130, L by A at position 130, K by Q at position 134, K by T at position 134, K by S at position 134, K by H at position 134, K by Q at position 136, K by T at position 136, K by S at position 136, K by H at position 136, E by Q at position 137, E by H at position 137, Y by H at position 163, Y by I at position 163, R by H at position 165, R by Q at position 165.

By 2D-scanning (see, SEQ ID Nos. 1016-1302, and table above): M by V at position 1, M by I at position 1, M by T at position 1, M by Q at position 1, M by A at position 1, L by V at position 5, L by I at position 5, L by T at position 5, L by Q at position 5, L by H at position 5, L by A at position 5, F by I at position 8, F by V at position 8, L by V at position 9, L by I at position 9, L by T at position 9, L by Q at position 9, L by H at position 9, L by A at position 9, R by H at position 11, R by Q at position 11, F by I at position 15, F by V at position 15, K by Q at position 19, K by T at position 19, K by S at position 19, K by H at position 19, W by S at position 22, W by H at position 22, N by H at position 25, N by S at position 25, N by Q at position 25, R by H position 27, R by Q position 27, L by V at position 28, L by I at position 28, L by T at position 28, L by Q at position 28, L by H at position 28, L by A at position 28, E by Q at position 29, E by H at position 29, Y by H at position 30, Y by I at position 30, L by V at position 32, L by I at position 32, L by T at position 32, L by Q at position 32, L by H at position 32, L by A at position 32, K by Q at position 33, K by T at position 33, K by S at position 33, K by H at position 33, R by H at position 35, R by Q at position 35, M by V at position 36, M by I at position 36, M by T at position 36, M by Q at position 36, M by A at position 36, D by Q at position 39, D by H at position 39, D by G at position 39, E by Q at position 42, E by H at position 42, K by Q at position 45, K by T at position 45, K by S at position 45, K by H at position 45, L by V at position 47, L by I at position 47, L by T at position 47, L by, Q at position 47, L by H at position 47, L by A at position 47, K by Q at position 52, K by T at position 52, K by S at position 52, K by H at position 52, F by I at position 67, F by V at position 67, R by H at position 71, R by Q at position 71, D by Q at position 73, D by H at position 73, D by G at position 73, E by Q at position 81, E by H at position 81, E by Q at position 85, E by H at position 85, Y by H at position 92, Y by I at position 92, K by Q at position 99, K by T at position 99, K by S at position 99, K by H at position 99, E by Q at position 103, E by H at position 103, E by Q at position 104, E by H at position 104, K by Q at position 105, K by T at position 105, K by S at position 105, K by H at position 105, E by Q at position 107, E by H at position 107, K by Q at position 108, K by T at position 108, K by S at position 108, K by H at position 108, E by Q at position 109, E by H at position 109, D by Q at position 110, D by H at position 110, D by G at position 110, F by I at position 111, F by V at position 111, R by H at position 113, R by Q at position 113, L by V at position 116, L by I at position 116, L by T at position 116, L by Q at position 116, L by H at position 116, L by A at position 116, L by V at position 120, L by I at position 120, L by T at position 120, L by Q at position 120, L by H at position 120, L by A at position 120, K by Q at position 123, K by T at position 123, K by S at position 123, K by H at position 123, R by H at position 124, R by Q at position 124, R by H at position 128, R by Q at position 128, L by V at position 130, L by I at position 130, L by T at position 130, L by Q at position 130, L by H at position 130, L by A at position 130, K by Q at position 134, K by T at position 134, K by S at position 134, K by H at position 134, K by Q at position 136, K by T at position 136, K by S at position 136, K by H at position 136, E by Q at position 137, E by H at position 137, Y by H at position 138, Y by I at position 138, R by H at position 152, R by Q at position 152, Y by H at position 155, Y by I at position 155, R by H at position 159, R by Q at position 159, Y by H at position 163, Y by I at position 163, R by H at position 165, R by Q at position 165, M by D at position 1, M by E at position 1, M by K at position 1, M by N at position 1, M by R at position 1, M by S at position 1, L by D at position 5, L by E at position 5, L by K at position 5, L by N at position 5, L by R at position 5, L by S at position 5, L by D at position 6, L by E at position 6, L by K at position 6, L by N at position 6, L by R at position 6, L by S at position 6, L by Q at position 6, L by T at position 6, F by E at position 8, F by K at position 8, F by R at position 8, F by D at position 8, L by D at position 9, L by E at position 9, L by K at position 9, L by N at position 9, L by R at position 9, L by S at position 9, Q by D at position 10, Q by E at position 10, Q by K at position 10, Q by N at position 10, Q by R at position 10, Q by S at position 10, Q by T at position 10, S by D at position 12, S by E at position 12, S by K at position 12, S by R at position 12, S by D at position 13, S by E at position 13, S by K at position 13, S by R at position 13, S by N at position 13, S by Q at position 13, S by T at position 13, N by D at position 14, N by E at position 14, N by K at position 14, N by Q at position 14, N by R at position 14, N by S at position 14, N by T at position 14, F by D at position 15, F by E at position 15, F by K at position 15, F by R at position 15, Q by D at position 16, Q by E at position 16, Q by K at position 16, Q by N at position 16, Q by R at position 16, Q by S at position 16, Q by T at position 16, C by D at position 17, C by E at position 17, C by K at position 17, C by N at position 17, C by Q at position 17, C by R at position 17, C by S at position 17, C by T at position 17, L by N at position 20, L by Q at position 20, L by R at position 20, L by S at position 20, L by T at position 20, L by D at position 20, L by E at position 20, L by K at position 20, W by D at position 22, W by E at position 22, W by K at position 22, W by R at position 22, Q by D at position 23, Q by E at position 23, Q by K at position 23, Q by R at position 23, L by D at position 24, L by E at position 24, L by K at position 24, L by R at position 24, W by D at position 79, W by E at position 79, W by K at position 79, W by R at position 79, N by D at position 80, N by E at position 80, N by K at position 80, N by R at position 80, T by D at position 82, T by E at position 82, T by K at position 82, T by R at position 82, I by D at position 83, I by E at position 83, I by K at position 83, I by R at position 83, I by N at position.83, I by Q at position 83, I by S at position 83, I by T at position 83, N by D at position 86, N by E at position 86, N by K at position 86, N by R at position 86, N by Q at position 86, N by S at position 86, N by T at position 86, L by D at position 87, L by E at position 87, L by K at position 87, L by R at position 87, L by N at position 87, L by Q at position 87, L by S at position 87, L by T at position 87, A by D at position 89, A by E at position 89, A by K at position 89, A by R at position 89, N by D at position 90, N by E at position 90, N by K at position 90, N by Q at position 90, N by R at position 90, N by S at position 90, N by T at position 90, V by D at position 91, V by E at position 91, V by K at position 91, V by N at position 91, V by Q at position 91, V by R at position 91, V by S at position 91, V by T at position 91, Q by D at position 94, Q by E at position 94, Q by Q at position 94, Q by N at position 94, Q by R at position 94, Q by S at position 94, Q by T at position 94, I by D at position 95, I by B at position 95, I by K at position 95, I by N at position 95, I by Q at position 95, I by R at position 95, I by S at position 95, I by T at position 95, H by D at position 97, H by E at position 97, H by K at position 97, H by N at position 97, H by Q at position 97, H by R at position 97, H by S at position 97, H by T at position 97, L by D at position 98, L by B at position 98, L by K at position 98, L by N at position 98, L by Q at position 98, L by R at position 98, L by S at position 98, L by T at position 98, V by D at position 101, V by E at position 101, V by K at position 101, V by N at position 101, V by Q at position 101, V by R at position 101, V by S at position 101, V by T at position 101, M by C at position 1, L by C at position 6, Q by C at position 10, S by C at position 13, Q by C at position 16, L by C at position 17, V by C at position 101, L by C at position 98, H by C at position 97, Q by C at position 94, V by C at position 91, N by C at position 90.

Since modifications will be apparent to those of skill in this art, it is intended that this invention be limited only by the scope of the appended claims.

SEQUENCE LISTING (1306 sequences)

SEQ ID NO: 1 - protein, 165 aa, Homo sapiens [sequence omitted]

SEQ ID NO: 2 - protein, 165 aa, Artificial Sequence
  D2A Mutant IFN-alpha 2b
CALPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 3 - protein, 165 aa, Artificial Sequence
  P4A Mutant IFN-alpha 2b
CDLAQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 4 - protein, 165 aa, Artificial Sequence
  Q5A Mutant IFN-alpha 2b
CDLPATHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 5 - protein, 165 aa, Artificial Sequence
  T6A Mutant IFN-alpha 2b
CDLPQAHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 6 - protein, 165 aa, Artificial Sequence
  H7A Mutant IFN-alpha 2b
CDLPQTASLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 7 - protein, 165 aa, Artificial Sequence
  S8A Mutant IFN-alpha 2b
CDLPQTHALGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 8 - protein, 165 aa, Artificial Sequence
  L9A Mutant IFN-alpha 2b
CDLPQTHSAGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 9 - protein, 165 aa, Artificial Sequence
  G10A Mutant IFN-alpha 2b
CDLPQTHSLASRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 10 - protein, 165 aa, Artificial Sequence
  S11A Mutant IFN-alpha 2b
CDLPQTHSLGARRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 11 - protein, 165 aa, Artificial Sequence
  R12A Mutant IFN-alpha 2b
CDLPQTHSLGSARTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 12 - protein, 165 aa, Artificial Sequence
  R13A Mutant IFN-alpha 2b
CDLPQTHSLGSRATLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 13 - protein, 165 aa, Artificial Sequence
  T14A Mutant IFN-alpha 2b
CDLPQTHSLGSRRALMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 14 - protein, 165 aa, Artificial Sequence
  L15A Mutant IFN-alpha 2b
CDLPQTHSLGSRRTAMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 15 - protein, 165 aa, Artificial Sequence
  M16A Mutant IFN-alpha 2b
CDLPQTHSLGSRRTLALLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 16 - protein, 165 aa, Artificial Sequence
  L17A Mutant IFN-alpha 2b
CDLPQTHSLGSRRTLMALAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 17 - protein, 165 aa, Artificial Sequence
  Q20A Mutant IFN-alpha 2b
CDLPQTHSLGSRRTLMLLAAMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 18 - protein, 165 aa, Artificial Sequence
  R23A Mutant IFN-alpha 2b
CDLPQTHSLGSRRTLMLLAQMRAISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 19 - protein, 165 aa, Artificial Sequence
  I24A Mutant IFN-alpha 2b
CDLPQTHSLGSRRTLMLLAQMRRASLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 20 - protein, 165 aa, Artificial Sequence
  S25A Mutant IFN-alpha 2b
CDLPQTHSLGSRRTLMLLAQMRRIALFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 21 - protein, 165 aa, Artificial Sequence
  L26A Mutant IFN-alpha 2b
CDLPQTHSLGSRRTLMLLAQMRRISAFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 22 - protein, 165 aa, Artificial Sequence
  S28A Mutant IFN-alpha 2b
CDLPQTHSLGSRRTLMLLAQMRRISLFACLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 23 - protein, 165 aa, Artificial Sequence
  C29A Mutant IFN-alpha 2b
CDLPQTHSLGSRRTLMLLAQMRRISLFSALKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 24 - protein, 165 aa, Artificial Sequence
  L30A Mutant IFN-alpha 2b
CDLPQTHSLGSRRTLMLLAQMRRISLFSCAKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 25 - protein, 165 aa, Artificial Sequence
  K31A Mutant IFN-alpha 2b
CDLPQTHSLGSRRTLMLLAQMRRISLFSCLADRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 26 - protein, 165 aa, Artificial Sequence
  D32A Mutant IFN-alpha 2b
CDLPQTHSLGSRRTLMLLAQMRRISLFSCLKARHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 27 - protein, 165 aa, Artificial Sequence
  R33A Mutant IFN-alpha 2b
CDLPQTHSLGSRRTLMLLAQMRRISLFSCLKDAHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 28 - protein, 165 aa, Artificial Sequence
  D35A Mutant IFN-alpha 2b
CDLPQTHSLGSRRTLMLLAQMRRISLFSCLKDRHAFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 29 - protein, 165 aa, Artificial Sequence
  G37A Mutant IFN-alpha 2b
CDLPQTHSLGSRRTLMLLAQMRRISLFSCLKDRHDFAFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 30 - protein, 165 aa, Artificial Sequence
  P39A Mutant IFN-alpha 2b
CDLPQTHSLGSRRTLMLLAQMRRISLFSCLKDRHDFGFAQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 31 - protein, 165 aa, Artificial Sequence
  E41A Mutant IFN-alpha 2b
CDLPQTHSLGSRRTLMLLAQMRRISLFSCLKDRHDFGFPQAEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 32 - protein, 165 aa, Artificial Sequence
  E42A Mutant IFN-alpha 2b
CDLPQTHSLGSRRTLMLLAQMRRISLFSCLKDRHDFGFPQEAFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 33 - protein, 165 aa, Artificial Sequence
  F43A Mutant IFN-alpha 2b
CDLPQTHSLGSRRTLMLLAQMRRISLFSCLKDRHDFGFPQEEAGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 34 - protein, 165 aa, Artificial Sequence
  N45A Mutant IFN-alpha 2b
CDLPQTHSLGSRRTLMLLAQMRRISLFSCLKDRHDFGFPQEEFGAQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 35 - protein, 165 aa, Artificial Sequence
  F47A Mutant IFN-alpha 2b
CDLPQTHSLGSRRTLMLLAQMRRISLFSCLKDRHDFGFPQEEFGNQAQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 36 - protein, 165 aa, Artificial Sequence
  E51A Mutant IFN-alpha 2b
CDLPQTHSLGSRRTLMLLAQMRRISLFSCLKDRHDFGFPQEEFGNQFQKAATIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 37 - protein, 165 aa, Artificial Sequence
  T52A Mutant IFN-alpha 2b
CDLPQTHSLGSRRTLMLLAQMRRISLFSCLKDRHDFGFPQEEFGNQFQKAEAIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 38 - protein, 165 aa, Artificial Sequence
  I53A Mutant IFN-alpha 2b
CDLPQTHSLGSRRTLMLLAQMRRISLFSCLKDRHDFGFPQEEFGNQFQKAETAPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 39 - protein, 165 aa, Artificial Sequence
  P54A Mutant IFN-alpha 2b
CDLPQTHSLGSRRTLMLLAQMRRISLFSCLKDRHDFGFPQEEFGNQFQKAETIAVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 40 - protein, 165 aa, Artificial Sequence
  V55A Mutant IFN-alpha 2b
CDLPQTHSLGSRRTLMLLAQMRRISLFSCLKDRHDFGFPQEEFGNQFQKAETIPALHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 41 - protein, 165 aa, Artificial Sequence
  L56A Mutant IFN-alpha 2b
CDLPQTHSLGSRRTLMLLAQMRRISLFSCLKDRHDFGFPQEEFGNQFQKAETIPVAHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 42 - protein, 165 aa, Artificial Sequence
  H57A Mutant IFN-alpha 2b
CDLPQTHSLGSRRTLMLLAQMRRISLFSCLKDRHDFGFPQEEFGNQFQKAETIPVLAEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 43 - protein, 165 aa, Artificial Sequence
  E58A Mutant IFN-alpha 2b
CDLPQTHSLGSRRTLMLLAQMRRISLFSCLKDRHDFGFPQEEFGNQFQKAETIPVLHAMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 44 - protein, 165 aa, Artificial Sequence
  M59A Mutant IFN-alpha 2b
CDLPQTHSLGSRRTLMLLAQMRRISLFSCLKDRHDFGFPQEEFGNQFQKAETIPVLHEAIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 45 - protein, 165 aa, Artificial Sequence
  I60A Mutant IFN-alpha 2b
CDLPQTHSLGSRRTLMLLAQMRRISLFSCLKDRHDFGFPQEEFGNQFQKAETIPVLHEMAQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 46 - protein, 165 aa, Artificial Sequence
  I63A Mutant IFN-alpha 2b
CDLPQTHSLGSRRTLMLLAQMRRISLFSCLKDRHDFGFPQEEFGNQFQKAETIPVLHEMIQQAFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 47 - protein, 165 aa, Artificial Sequence
  F64A Mutant IFN-alpha 2b
CDLPQTHSLGSRRTLMLLAQMRRISLFSCLKDRHDFGFPQEEFGNQFQKAETIPVLHEMIQQIANLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 48 - protein, 165 aa, Artificial Sequence
  N65A Mutant IFN-alpha 2b
CDLPQTHSLGSRRTLMLLAQMRRISLFSCLKDRHDFGFPQEEFGNQFQKAETIPVLHEMIQQIFALFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 49 - protein, 165 aa, Artificial Sequence
  L66A Mutant IFN-alpha 2b
CDLPQTHSLGSRRTLMLLAQMRRISLFSCLKDRHDFGFPQEEFGNQFQKAETIPVLHEMIQQIFNAFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 50 - protein, 165 aa, Artificial Sequence
  F67A Mutant IFN-alpha 2b
CDLPQTHSLGSRRTLMLLAQMRRISLFSCLKDRHDFGFPQEEFGNQFQKAETIPVLHEMIQQIFNLASTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 51 - protein, 165 aa, Artificial Sequence
  T69A Mutant IFN-alpha 2b
CDLPQTHSLGSRRTLMLLAQMRRISLFSCLKDRHDFGFPQEEFGNQFQKAETIPVLHEMIQQIFNLFSAKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 52 - protein, 165 aa, Artificial Sequence
  K70A Mutant IFN-alpha 2b
CDLPQTHSLGSRRTLMLLAQMRRISLFSCLKDRHDFGFPQEEFGNQFQKAETIPVLHEMIQQIFNLFSTADSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 53 - protein, 165 aa, Artificial Sequence
  D71A Mutant IFN-alpha 2b
CDLPQTHSLGSRRTLMLLAQMRRISLFSCLKDRHDFGFPQEEFGNQFQKAETIPVLHEMIQQIFNLFSTKASSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 54 - protein, 165 aa, Artificial Sequence
  S72A Mutant IFN-alpha 2b
CDLPQTHSLGSRRTLMLLAQMRRISLFSCLKDRHDFGFPQEEFGNQFQKAETIPVLHEMIQQIFNLFSTKDASAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 55 - protein, 165 aa, Artificial Sequence
  W76A Mutant IFN-alpha 2b
CDLPQTHSLGSRRTLMLLAQMRRISLFSCLKDRHDFGFPQEEFGNQFQKAETIPVLHEMIQQIFNLFSTKDSSAAADETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 56 - protein, 165 aa, Artificial Sequence
  D77A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWAETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 57 - protein, 165 aa, Artificial Sequence
  E78A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDATLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 58 - protein, 165 aa, Artificial Sequence
  L81A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLADKFYTELYQQLNDLEACVIQGVGVTETPLMKEDSILAVRKYFQRITLYLKEKKYSPCAWEVVRAEIMRSFSLSTNLQESLRSKE

SEQ ID NO: 59 - protein, 165 aa, Artificial Sequence
  D82A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLAKFYTELYQQLNDLEACVIQGVGVTETPLMKEDSILAVRKYFQRITLYLKEKKYSPCAWEVVRAEIMRSFSLSTNLQESLRSKE

SEQ ID NO: 60 - protein, 165 aa, Artificial Sequence
  K83A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDAFYTELYQQLNDLEACVIQGVGVTETPLMKEDSILAVRKYFQRITLYLKEKKYSPCAWEVVRAEIMRSFSLSTNLQESLRSKE

SEQ ID NO: 61 - protein, 165 aa, Artificial Sequence
  F84A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKAYTELYQQLNDLEACVIQGVGVTETPLMKEDSILAVRKYFQRITLYLKEKKYSPCAWEVVRAEIMRSFSLSTNLQESLRSKE

SEQ ID NO: 62 - protein, 165 aa, Artificial Sequence
  Y85A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFATELYQQLNDLEACVIQGVGVTETPLMKEDSILAVRKYFQRITLYLKEKKYSPCAWEVVRAEIMRSFSLSTNLQESLRSKE

SEQ ID NO: 63 - protein, 165 aa, Artificial Sequence
  Y89A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELAQQLNDLEACVIQGVGVTETPLMKEDSILAVRKYFQRITLYLKEKKYSPCAWEVVRAEIMRSFSLSTNLQESLRSKE

SEQ ID NO: 64 - protein, 165 aa, Artificial Sequence
  Q90A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYAQLNDLEACVIQGVGVTETPLMKEDSILAVRKYFQRITLYLKEKKYSPCAWEVVRAEIMRSFSLSTNLQESLRSKE

SEQ ID NO: 65 - protein, 165 aa, Artificial Sequence
  Q91A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQALNDLEACVIQGVGVTETPLMKEDSILAVRKYFQRITLYLKEKKYSPCAWEVVRAEIMRSFSLSTNLQESLRSKE

SEQ ID NO: 66 - protein, 165 aa, Artificial Sequence
  N93A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLADLEACVIQGVGVTETPLMKEDSILAVRKYFQRITLYLKEKKYSPCAWEVVRAEIMRSFSLSTNLQESLRSKE

SEQ ID NO: 67 - protein, 165 aa, Artificial Sequence
  D94A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNALEACVIQGVGVTETPLMKEDSILAVRKYFQRITLYLKEKKYSPCAWEVVRAEIMRSFSLSTNLQESLRSKE

SEQ ID NO: 68 - protein, 165 aa, Artificial Sequence
  C98A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEAAVIQGVGVTETPLMKEDSILAVRKYFQRITLYLKEKKYSPCAWEVVRAEIMRSFSLSTNLQESLRSKE

SEQ ID NO: 69 - protein, 165 aa, Artificial Sequence
  V99A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACAIQGVGVTETPLMKEDSILAVRKYFQRITLYLKEKKYSPCAWEVVRAEIMRSFSLSTNLQESLRSKE

SEQ ID NO: 70 - protein, 165 aa, Artificial Sequence
  G104A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVAVTETPLMKEDSILAVRKYFQRITLYLKEKKYSPCAWEVVRAEIMRSFSLSTNLQESLRSKE

SEQ ID NO: 71 - protein, 165 aa, Artificial Sequence
  L110A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPAMKEDSILAVRKYFQRITLYLKEKKYSPCAWEVVRAEIMRSFSLSTNLQESLRSKE

SEQ ID NO: 72 - protein, 165 aa, Artificial Sequence
  S115A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDAILAVRKYFQRITLYLKEKKYSPCAWEVVRAEIMRSFSLSTNLQESLRSKE

SEQ ID NO: 73 - protein, 165 aa, Artificial Sequence
  Y122A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKAFQRITLYLKEKKYSPCAWEVVRAEIMRSFSLSTNLQESLRSKE

SEQ ID NO: 74 - protein, 165 aa, Artificial Sequence
  W140A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAAEVVRAEIMRSFSLSTNLQESLRSKE

SEQ ID NO: 75 - protein, 165 aa, Artificial Sequence
  E146A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAAIMRSFSLSTNLQESLRSKE

SEQ ID NO: 76 - protein, 165 aa, Artificial Sequence
  L3V Mutant IFN-alpha 2b
CDVPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 77 - protein, 165 aa, Artificial Sequence
  R12H Mutant IFN-alpha 2b
CDLPQTHSLGSHRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 78 - protein, 165 aa, Artificial Sequence
  R13H Mutant IFN-alpha 2b
CDLPQTHSLGSRHTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 79 - protein, 165 aa, Artificial Sequence
  M16V Mutant IFN-alpha 2b
CDLPQTHSLGSRRTLVLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 80 - protein, 165 aa, Artificial Sequence
  M16I Mutant IFN-alpha 2b
CDLPQTHSLGSRRTLILLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 81 - protein, 165 aa, Artificial Sequence
  R22H Mutant IFN-alpha 2b
CDLPQTHSLGSRRTLMLLAQMHRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 82 - protein, 165 aa, Artificial Sequence
  F27I Mutant IFN-alpha 2b
CDLPQTHSLGSRRTLMLLAQMRRISLISCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 83 - protein, 165 aa, Artificial Sequence
  F27V Mutant IFN-alpha 2b
CDLPQTHSLGSRRTLMLLAQMRRISLVSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 84 - protein, 165 aa, Artificial Sequence
  L30I Mutant IFN-alpha 2b
CDLPQTHSLGSRRTLMLLAQMRRISLFSCIKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 85 - protein, 165 aa, Artificial Sequence
  K31Q Mutant IFN-alpha 2b
CDLPQTHSLGSRRTLMLLAQMRRISLFSCLQDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 86 - protein, 165 aa, Artificial Sequence
  R33H Mutant IFN-alpha 2b
CDLPQTHSLGSRRTLMLLAQMRRISLFSCLKDHHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 87 - protein, 165 aa, Artificial Sequence
  E41Q Mutant IFN-alpha 2b
CDLPQTHSLGSRRTLMLLAQMRRISLFSCLKDRHDFGFPQQEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 88 - protein, 165 aa, Artificial Sequence
  E41H Mutant IFN-alpha 2b
CDLPQTHSLGSRRTLMLLAQMRRISLFSCLKDRHDFGFPQHEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 89 - protein, 165 aa, Artificial Sequence
  E58Q Mutant IFN-alpha 2b
CDLPQTHSLGSRRTLMLLAQMRRISLFSCLKDRHDFGFPQEEFGNQFQKAETIPVLHQMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 90 - protein, 165 aa, Artificial Sequence
  E58H Mutant IFN-alpha 2b
CDLPQTHSLGSRRTLMLLAQMRRISLFSCLKDRHDFGFPQEEFGNQFQKAETIPVLHHMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 91 - protein, 165 aa, Artificial Sequence
  K70T Mutant IFN-alpha 2b
CDLPQTHSLGSRRTLMLLAQMRRISLFSCLKDRHDFGFPQEEFGNQFQKAETIPVLHEMIQQIFNLFSTTDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 92 - protein, 165 aa, Artificial Sequence
  E78Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDQTLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 93 - protein, 165 aa, Artificial Sequence
  E78H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDHTLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 94 - protein, 165 aa, Artificial Sequence
  Y89I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELIQQLNDLEACVIQGVGVTETPLMKEDSILAVRKYFQRITLYLKEKKYSPCAWEVVRAEIMRSFSLSTNLQESLRSKE

SEQ ID NO: 95 - protein, 165 aa, Artificial Sequence
  E107Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTQTPLMKEDSILAVRKYFQRITLYLKEKKYSPCAWEVVRAEIMRSFSLSTNLQESLRSKE

SEQ ID NO: 96 - protein, 165 aa, Artificial Sequence
  E107H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTHTPLMKEDSILAVRKYFQRITLYLKEKKYSPCAWEVVRAEIMRSFSLSTNLQESLRSKE

SEQ ID NO: 97 - protein, 165 aa, Artificial Sequence
  P109A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETALMKEDSILAVRKYFQRITLYLKEKKYSPCAWEVVRAEIMRSFSLSTNLQESLRSKE

SEQ ID NO: 98 - protein, 165 aa, Artificial Sequence
  L110V Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPVMKEDSILAVRKYFQRITLYLKEKKYSPCAWEVVRAEIMRSFSLSTNLQESLRSKE

SEQ ID NO: 99 - protein, 165 aa, Artificial Sequence
  M111I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLIKEDSILAVRKYFQRITLYLKEKKYSPCAWEVVRAEIMRSFSLSTNLQESLRSKE

SEQ ID NO: 100 - protein, 165 aa, Artificial Sequence
  E113Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKQDSILAVRKYFQRITLYLKEKKYSPCAWEVVRAEIMRSFSLSTNLQESLRSKE

SEQ ID NO: 101 - protein, 165 aa, Artificial Sequence
  E113H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKHDSILAVRKYFQRITLYLKEKKYSPCAWEVVRAEIMRSFSLSTNLQESLRSKE

SEQ ID NO: 102 - protein, 165 aa, Artificial Sequence
  L117V Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIVAVRKYFQRITLYLKEKKYSPCAWEVVRAEIMRSFSLSTNLQESLRSKE

SEQ ID NO: 103 - protein, 165 aa, Artificial Sequence
  L117I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIIAVRKYFQRITLYLKEKKYSPCAWEVVRAEIMRSFSLSTNLQESLRSKE

SEQ ID NO: 104 - protein, 165 aa, Artificial Sequence
  K121Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRQYFQRITLYLKEKKYSPCAWEVVRAEIMRSFSLSTNLQESLRSKE

SEQ ID NO: 105 - protein, 165 aa, Artificial Sequence
  K121T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRTYFQRITLYLKEKKYSPCAWEVVRAEIMRSFSLSTNLQESLRSKE

SEQ ID NO: 106 - protein, 165 aa, Artificial Sequence
  R125H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQHITLYLKEKKYSPCAWEVVRAEIMRSFSLSTNLQESLRSKE

SEQ ID NO: 107 - protein, 165 aa, Artificial Sequence
  R125Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQQITLYLKEKKYSPCAWEVVRAEIMRSFSLSTNLQESLRSKE

SEQ ID NO: 108 - protein, 165 aa, Artificial Sequence
  L128V Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITVYLKEKKYSPCAWEVVRAEIMRSFSLSTNLQESLRSKE

SEQ ID NO: 109 - protein, 165 aa, Artificial Sequence
  L128I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITIYLKEKKYSPCAWEVVRAEIMRSFSLSTNLQESLRSKE

SEQ ID NO: 110 - protein, 165 aa, Artificial Sequence
  K131Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLQEKKYSPCAWEVVRAEIMRSFSLSTNLQESLRSKE

SEQ ID NO: 111 - protein, 165 aa, Artificial Sequence
  K131T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLTEKKYSPCAWEVVRAEIMRSFSLSTNLQESLRSKE

SEQ ID NO: 112 - protein, 165 aa, Artificial Sequence
  E132Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKQKKYSPCAWEVVRAEIMRSFSLSTNLQESLRSKE

SEQ ID NO: 113 - protein, 165 aa, Artificial Sequence
  E132H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKHKKYSPCAWEVVRAEIMRSFSLSTNLQESLRSKE

SEQ ID NO: 114 - protein, 165 aa, Artificial Sequence
  K133Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEQKYSPCAWEVVRAEIMRSFSLSTNLQESLRSKE

SEQ ID NO: 115 - protein, 165 aa, Artificial Sequence
  K133T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKETKYSPCAWEVVRAEIMRSFSLSTNLQESLRSKE

SEQ ID NO: 116 - protein, 165 aa, Artificial Sequence
  K134Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKQYSPCAWEVVRAEIMRSFSLSTNLQESLRSKE

SEQ ID NO: 117 - protein, 165 aa, Artificial Sequence
  Y135H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKHSPCAWEVVRAEIMRSFSLSTNLQESLRSKE

SEQ ID NO: 118 - protein, 165 aa, Artificial Sequence
  Y135I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKISPCAWEVVRAEIMRSFSLSTNLQESLRSKE

SEQ ID NO: 119 - protein, 165 aa, Artificial Sequence
  P137A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSACAWEVVRAEIMRSFSLSTNLQESLRSKE

SEQ ID NO: 120 - protein, 165 aa, Artificial Sequence
  M148V Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIVRSFSLSTNLQESLRSKE

SEQ ID NO: 121 - protein, 165 aa, Artificial Sequence
  M148I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIIRSFSLSTNLQESLRSKE

SEQ ID NO: 122 - protein, 165 aa, Artificial Sequence
  R149H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMHSFSLSTNLQESLRSKE

SEQ ID NO: 123 - protein, 165 aa, Artificial Sequence
  R149Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMQSFSLSTNLQESLRSKE

SEQ ID NO: 124 - protein, 165 aa, Artificial Sequence
  E159Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQQSLRSKE

SEQ ID NO: 125 - protein, 165 aa, Artificial Sequence
  E159H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQHSLRSKE

SEQ ID NO: 126 - protein, 165 aa, Artificial Sequence
  P4S Mutant IFN-alpha 2b
CDLSQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 127 - protein, 165 aa, Artificial Sequence
  Q5N/H7S Mutant IFN-alpha 2b
CDLPNTSSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 128 - protein, 165 aa, Artificial Sequence
  Q5N/H7T Mutant IFN-alpha 2b
CDLPNTTSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 129 - protein, 165 aa, Artificial Sequence
  T6N/S8S Mutant IFN-alpha 2b
CDLPQNHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 130 - protein, 165 aa, Artificial Sequence
  S8N/G10S Mutant IFN-alpha 2b
CDLPQTHNLSSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 131 - protein, 165 aa, Artificial Sequence
  S8N/G10T Mutant IFN-alpha 2b
CDLPQTHNLTSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 132 - protein, 165 aa, Artificial Sequence
  M21N/R23S Mutant IFN-alpha 2b
CDLPQTHSLGSRRTLMLLAQNRSISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 133 - protein, 165 aa, Artificial Sequence
  R23N/S25T Mutant IFN-alpha 2b
CDLPQTHSLGSRRTLMLLAQMRNITLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 134 - protein, 165 aa, Artificial Sequence
  I24N/L26S Mutant IFN-alpha 2b
CDLPQTHSLGSRRTLMLLAQMRRNSSFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 135 - protein, 165 aa, Artificial Sequence
  S25N/F27S Mutant IFN-alpha 2b
CDLPQTHSLGSRRTLMLLAQMRRINLSSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 136 - protein, 165 aa, Artificial Sequence
  S25N/F27T Mutant IFN-alpha 2b
CDLPQTHSLGSRRTLMLLAQMRRINLTSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 137 - protein, 165 aa, Artificial Sequence
  L26N/S28S Mutant IFN-alpha 2b
CDLPQTHSLGSRRTLMLLAQMRRISNFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 138 - protein, 165 aa, Artificial Sequence
  L26N/S28T Mutant IFN-alpha 2b
CDLPQTHSLGSRRTLMLLAQMRRISNFTCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 139 - protein, 165 aa, Artificial Sequence
  L30N/D32S Mutant IFN-alpha 2b
CDLPQTHSLGSRRTLMLLAQMRRISLFSCNKSRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 140 - protein, 165 aa, Artificial Sequence
  R33N/D35S Mutant IFN-alpha 2b
CDLPQTHSLGSRRTLMLLAQMRRISLFSCLKDNHSFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 141 - protein, 165 aa, Artificial Sequence
  R33N/D35T Mutant IFN-alpha 2b
CDLPQTHSLGSRRTLMLLAQMRRISLFSCLKDNHTFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 142 - protein, 165 aa, Artificial Sequence
  H34N/F36S Mutant IFN-alpha 2b
CDLPQTHSLGSRRTLMLLAQMRRISLFSCLKDRNDSGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 143 - protein, 165 aa, Artificial Sequence
  H34N/F36T Mutant IFN-alpha 2b
CDLPQTHSLGSRRTLMLLAQMRRISLFSCLKDRNDTGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 144 - protein, 165 aa, Artificial Sequence
  D35N/G37S Mutant IFN-alpha 2b
CDLPQTHSLGSRRTLMLLAQMRRISLFSCLKDRHNFSFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 145 - protein, 165 aa, Artificial Sequence
  F36N/F38S Mutant IFN-alpha 2b
CDLPQTHSLGSRRTLMLLAQMRRISLFSCLKDRHDNGSPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 146 - protein, 165 aa, Artificial Sequence
  F36N/F38T Mutant IFN-alpha 2b
CDLPQTHSLGSRRTLMLLAQMRRISLFSCLKDRHDNGTPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 147 - protein, 165 aa, Artificial Sequence
  G37N/P39T Mutant IFN-alpha 2b
CDLPQTHSLGSRRTLMLLAQMRRISLFSCLKDRHDFNFTQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 148 - protein, 165 aa, Artificial Sequence
  F38N/Q40S Mutant IFN-alpha 2b
CDLPQTHSLGSRRTLMLLAQMRRISLFSCLKDRHDFGNPSEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 149 - protein, 165 aa, Artificial Sequence
  F38N/Q40T Mutant IFN-alpha 2b
CDLPQTHSLGSRRTLMLLAQMRRISLFSCLKDRHDFGNPTEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 150 - protein, 165 aa, Artificial Sequence
  P39N/E41S Mutant IFN-alpha 2b
CDLPQTHSLGSRRTLMLLAQMRRISLFSCLKDRHDFGFNQSEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 151 - protein, 165 aa, Artificial Sequence
  P39N/E41T Mutant IFN-alpha 2b
CDLPQTHSLGSRRTLMLLAQMRRISLFSCLKDRHDFGFNQTEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 152 - protein, 165 aa, Artificial Sequence
  Q40N/E42S Mutant IFN-alpha 2b
CDLPQTHSLGSRRTLMLLAQMRRISLFSCLKDRHDFGFPNESFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 153 - protein, 165 aa, Artificial Sequence
  Q40N/E42T Mutant IFN-alpha 2b
CDLPQTHSLGSRRTLMLLAQMRRISLFSCLKDRHDFGFPNETFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 154 - protein, 165 aa, Artificial Sequence
  E41N/F43S Mutant IFN-alpha 2b
CDLPQTHSLGSRRTLMLLAQMRRISLFSCLKDRHDFGFPQNESGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 155 - protein, 165 aa, Artificial Sequence
  E41N/F43T Mutant IFN-alpha 2b
CDLPQTHSLGSRRTLMLLAQMRRISLFSCLKDRHDFGFPQNETGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 156 - protein, 165 aa, Artificial Sequence
  G44N/Q46S Mutant IFN-alpha 2b
CDLPQTHSLGSRRTLMLLAQMRRISLFSCLKDRHDFGFPQEEFNNSFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 157 - protein, 165 aa, Artificial Sequence
  G44N/Q46T Mutant IFN-alpha 2b
CDLPQTHSLGSRRTLMLLAQMRRISLFSCLKDRHDFGFPQEEFNNTFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 158 - protein, 165 aa, Artificial Sequence
  N45N/F47S Mutant IFN-alpha 2b
CDLPQTHSLGSRRTLMLLAQMRRISLFSCLKDRHDFGFPQEEFGNQSQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 159 - protein, 165 aa, Artificial Sequence
  N45N/F47T Mutant IFN-alpha 2b
CDLPQTHSLGSRRTLMLLAQMRRISLFSCLKDRHDFGFPQEEFGNQTQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 160 - protein, 165 aa, Artificial Sequence
  Q46N/Q48S Mutant IFN-alpha 2b
CDLPQTHSLGSRRTLMLLAQMRRISLFSCLKDRHDFGFPQEEFGNNFSKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 161 - protein, 165 aa, Artificial Sequence
  Q46N/Q48T Mutant IFN-alpha 2b
CDLPQTHSLGSRRTLMLLAQMRRISLFSCLKDRHDFGFPQEEFGNNFTKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 162 - protein, 165 aa, Artificial Sequence
  F47N/K49S Mutant IFN-alpha 2b
CDLPQTHSLGSRRTLMLLAQMRRISLFSCLKDRHDFGFPQEEFGNQNQSAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 163 - protein, 165 aa, Artificial Sequence
  F47N/K49T Mutant IFN-alpha 2b
CDLPQTHSLGSRRTLMLLAQMRRISLFSCLKDRHDFGFPQEEFGNQNQTAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 164 - protein, 165 aa, Artificial Sequence
  K49N/E51S Mutant IFN-alpha 2b
CDLPQTHSLGSRRTLMLLAQMRRISLFSCLKDRHDFGFPQEEFGNQFQNASTIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 165 - protein, 165 aa, Artificial Sequence
  A75N/D77S Mutant IFN-alpha 2b
CDLPQTHSLGSRRTLMLLAQMRRISLFSCLKDRHDFGFPQEEFGNQFQKAETIPVLHEMIQQIFNLFSTKDSSANWSETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 166 - protein, 165 aa, Artificial Sequence
  I100N/G102S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVNQSVGVTETPLMKEDSILAVRKYFQRITLYLKEKKYSPCAWEVVRAEIMRSFSLSTNLQESLRSKE

SEQ ID NO: 167 - protein, 165 aa, Artificial Sequence
  I100N/G102T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVNQTVGVTETPLMKEDSILAVRKYFQRITLYLKEKKYSPCAWEVVRAEIMRSFSLSTNLQESLRSKE

SEQ ID NO: 168 - protein, 165 aa, Artificial Sequence
  V103N/V105S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGNGSTETPLMKEDSILAVRKYFQRITLYLKEKKYSPCAWEVVRAEIMRSFSLSTNLQESLRSKE

SEQ ID NO: 169 - protein, 165 aa, Artificial Sequence
  V103N/V105T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGNGTTETPLMKEDSILAVRKYFQRITLYLKEKKYSPCAWEVVRAEIMRSFSLSTNLQESLRSKE

SEQ ID NO: 170 - protein, 165 aa, Artificial Sequence
  G104N/T106T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVNVTETPLMKEDSILAVRKYFQRITLYLKEKKYSPCAWEVVRAEIMRSFSLSTNLQESLRSKE

SEQ ID NO: 171 - protein, 165 aa, Artificial Sequence
  V105N/E107S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGNTSTPLMKEDSILAVRKYFQRITLYLKEKKYSPCAWEVVRAEIMRSFSLSTNLQESLRSKE

SEQ ID NO: 172 - protein, 165 aa, Artificial Sequence
  T106N/T108S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVNESPLMKEDSILAVRKYFQRITLYLKEKKYSPCAWEVVRAEIMRSFSLSTNLQESLRSKE

SEQ ID NO: 173 - protein, 165 aa, Artificial Sequence
  T106N/T108T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVNETPLMKEDSILAVRKYFQRITLYLKEKKYSPCAWEVVRAEIMRSFSLSTNLQESLRSKE

SEQ ID NO: 174 - protein, 165 aa, Artificial Sequence
  E107N/P109S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTNTSLMKEDSILAVRKYFQRITLYLKEKKYSPCAWEVVRAEIMRSFSLSTNLQESLRSKE

SEQ ID NO: 175 - protein, 165 aa, Artificial Sequence
  E107N/P109T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTNTTLMKEDSILAVRKYFQRITLYLKEKKYSPCAWEVVRAEIMRSFSLSTNLQESLRSKE

SEQ ID NO: 176 - protein, 165 aa, Artificial Sequence
  K134N/S136T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKNYTPCAWEVVRAEIMRSFSLSTNLQESLRSKE

SEQ ID NO: 177 - protein, 165 aa, Artificial Sequence
  L157N/E159S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNNQSSLRSKE

SEQ ID NO: 178 - protein, 165 aa, Artificial Sequence
  L157N/E159T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNNQTSLRSKE

SEQ ID NO: 179 - protein, 165 aa, Artificial Sequence
  Q158N/S160T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLNETLRSKE

SEQ ID NO: 180 - protein, 165 aa, Artificial Sequence
  E159N/L161S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQNSSRSKE

SEQ ID NO: 181 - protein, 165 aa, Artificial Sequence
  E159N/L161T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQNSTRSKE

SEQ ID NO: 182 - protein, 165 aa, Homo sapiens
  ref <308>: DATABASE ACCESSION NUMBER: Genbank CAA23805
  ref <309>: DATABASE ENTRY DATE: 1994-12-17
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 183 - protein, 166 aa, Homo sapiens
  ref <308>: DATABASE ACCESSION NUMBER: Genbank P01566
  ref <309>: DATABASE ENTRY DATE: 1986-07-21
CDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 184 - protein, 174 aa, Marmota monax
  ref <308>: DATABASE ACCESSION NUMBER: Genbank AAL76913
  ref <309>: DATABASE ENTRY DATE: 2002-02-12
CDLPQIHNLGLETSEENEEGALTLLEKMRRIPIFSCLNYRKDFAFPQEQLEGEQVQKAQAVAVLHQMTQQILNLFSTQKAFAAWDKTLLDTFLSGLYQLLDDLKACGSKQVGVEEAVRKYFHRITVYLKEKKYLPCAWEVVRTEIMKSFSLSVNLYERLRSMEGDLVQQGNASH

SEQ ID NO: 185 - protein, 165 aa, Homo sapiens
CDLPQTHSLGSRRTLMLLAQMRRISLFSCLKDRRDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 186 - protein, 166 aa, Homo sapiens
  ref <308>: DATABASE ACCESSION NUMBER: Genbank AAB59403
  ref <309>: DATABASE ENTRY DATE: 1994-11-15
CDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 187 - protein, 166 aa, Homo sapiens
  ref <308>: DATABASE ACCESSION NUMBER: Genbank CAA26702
  ref <309>: DATABASE ENTRY DATE: 1995-03-30
CDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 188 - protein, 166 aa, Homo sapiens
  ref <308>: DATABASE ACCESSION NUMBER: Genbank CAA26704
  ref <309>: DATABASE ENTRY DATE: 1995-03-30
CDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 189 - protein, 166 aa, Homo sapiens
  ref <308>: DATABASE ACCESSION NUMBER: Genbank NP_066546
  ref <309>: DATABASE ENTRY DATE: 2000-11-02
CDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 190 - protein, 166 aa, Homo sapiens
  ref <308>: DATABASE ACCESSION NUMBER: Genbank CAA26701
  ref <309>: DATABASE ENTRY DATE: 1995-03-30
CDLPQTHSLGNRRALILLAQMGRISHFSCLKDRHDFGFPEEEFDGHQFQKTQAISVLHEMIQQTFNLFSTEDSSAAWEQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 191 - protein, 166 aa, Homo sapiens
  ref <308>: DATABASE ACCESSION NUMBER: Genbank AAA52725
  ref <309>: DATABASE ENTRY DATE: 1994-11-08
CDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 192 - protein, 166 aa, Homo sapiens
  ref <308>: DATABASE ACCESSION NUMBER: Genbank CAA23792
  ref <309>: DATABASE ENTRY DATE: 1994-08-04
CDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 193 - protein, 166 aa, Homo sapiens
  ref <308>: DATABASE ACCESSION NUMBER: Genbank CAA23794
  ref <309>: DATABASE ENTRY DATE: 1994-12-17
CNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 194 - protein, 166 aa, Homo sapiens
  ref <308>: DATABASE ACCESSION NUMBER: Genbank AAA52718
  ref <309>: DATABASE ENTRY DATE: 1994-11-08
CDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 195 - protein, 166 aa, Homo sapiens
  ref <308>: DATABASE ACCESSION NUMBER: Genbank CAA26903
  ref <309>: DATABASE ENTRY DATE: 1995-03-30
CDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 196 - protein, 166 aa, Homo sapiens
  ref <308>: DATABASE ACCESSION NUMBER: Genbank AAC41702
  ref <309>: DATABASE ENTRY DATE: 1995-01-01
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 197 - protein, 166 aa, Homo sapiens; identical to SEQ ID NO: 196
  ref <308>: DATABASE ACCESSION NUMBER: Genbank CAA23795
  ref <309>: DATABASE ENTRY DATE: 1993-09-12

SEQ ID NO: 198 - protein, 183 aa, Homo sapiens
  ref <308>: DATABASE ACCESSION NUMBER: Genbank CAA00839
  ref <309>: DATABASE ENTRY DATE: 1993-12-03
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 199 - protein, 146 aa, Homo sapiens
  ref <308>: DATABASE ACCESSION NUMBER: Genbank CAA31639
  ref <309>: DATABASE ENTRY DATE: 1994-11-15
CYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 200 - protein, 160 aa, Homo sapiens
  ref <308>: DATABASE ACCESSION NUMBER: Genbank NP_000563
  ref <309>: DATABASE ENTRY DATE: 2000-10-31
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 201 - protein, 166 aa, Homo sapiens
  ref <308>: DATABASE ACCESSION NUMBER: Genbank AAA52400
  ref <309>: DATABASE ENTRY DATE: 1994-11-08
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 202 - protein, 127 aa, Homo sapiens [sequence omitted]

SEQ ID NO: 203 - protein, 209 aa, Homo sapiens
  ref <308>: DATABASE ACCESSION NUMBER: Genbank AAA19825
  ref <309>: DATABASE ENTRY DATE: 1994-07-19
TQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 204 - protein, 133 aa, Homo sapiens [sequence omitted]

SEQ ID NO: 205 - protein, 133 aa, Homo sapiens
  ref <308>: DATABASE ACCESSION NUMBER: Genbank AAA59146
  ref <309>: DATABASE ENTRY DATE: 1995-01-06
APMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 206 - protein, 248 aa, Homo sapiens
  ref <308>: DATABASE ACCESSION NUMBER: Genbank AAA85450
  ref <309>: DATABASE ENTRY DATE: 1996-01-19
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 207 - protein, 129 aa, Homo sapiens [sequence omitted]

SEQ ID NO: 208 - protein, 115 aa, Homo sapiens
  ref <308>: DATABASE ACCESSION NUMBER: Genbank CAA28390
  ref <309>: DATABASE ENTRY DATE: 1995-03-21
IPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 209 - protein, 112 aa, Homo sapiens
  ref <308>: DATABASE ACCESSION NUMBER: Genbank NP_002179
  ref <309>: DATABASE ENTRY DATE: 2000-10-31
GPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFN

SEQ ID NO: 210 - protein, 177 aa, Homo sapiens
  ref <308>: DATABASE ACCESSION NUMBER: Genbank CAA27168
  ref <309>: DATABASE ENTRY DATE: 1995-03-21
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 211 - protein, 146 aa, Homo sapiens
  ref <308>: DATABASE ACCESSION NUMBER: Genbank AAA60470
  ref <309>: DATABASE ENTRY DATE: 1995-01-13
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 212 - protein, 200 aa, Homo sapiens
  ref <308>: DATABASE ACCESSION NUMBER: Genbank NP_000605
  ref <309>: DATABASE ENTRY DATE: 2002-07-17
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 213 - protein, 180 aa, Homo sapiens
  ref <308>: DATABASE ACCESSION NUMBER: Genbank CAA32147
  ref <309>: DATABASE ENTRY DATE: 1995-03-22
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 214 - protein, 227 aa, Homo sapiens
  ref <308>: DATABASE ACCESSION NUMBER: Genbank AAA36388
  ref <309>: DATABASE ENTRY DATE: 1993-04-27
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 215 - protein, 197 aa, Homo sapiens
  ref <308>: DATABASE ACCESSION NUMBER: Genbank AF101062
  ref <309>: DATABASE ENTRY DATE: 1999-03-03
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 216 - protein, 191 aa, Homo sapiens [sequence omitted]

SEQ ID NO: 217 - protein, 183 aa, Homo sapiens; identical to SEQ ID NO: 198
  ref <308>: DATABASE ACCESSION NUMBER: Genbank AAD13886
  ref <309>: DATABASE ENTRY DATE: 1993-06-28

SEQ ID NO: 218 - DNA, 55 bp, Artificial Sequence
  EcoRI Forward Primer
gcctgtatgatttattggatgttggaattccctgatgcggtattttctccttacg

SEQ ID NO: 219 - DNA, 55 bp, Artificial Sequence
  EcoRI Reverse Primer
cgtaaggagaaaataccgcatcagggaattccaacatccaataaatcatacaggc

SEQ ID NO: 220 - DNA, 35 bp, Artificial Sequence
  Seq ClaI Forward Primer
ctgattatcaaccgcggtacatatgattgacatgc

SEQ ID NO: 221 - DNA, 31 bp, Artificial Sequence
  Seq ClaI Reverse Primer
tacgggataataccgcgccacatagcagaac

SEQ ID NO: 222 - DNA, 18 bp, Artificial Sequence
  Seq Forward Primer
cctgatgaaggaggactc

SEQ ID NO: 223 - DNA, 18 bp, Artificial Sequence
  Seq Reverse Primer
ccaagcagcagatgagtc

SEQ ID NO: 224 - DNA, 31 bp, Artificial Sequence
  IFN alpha-2b 5' Primer
tcagctgcaagtcaagctgctctgtgggctg

SEQ ID NO: 225 - DNA, 48 bp, Artificial Sequence
  IFN alpha-2b 3' Primer
gctctagatcattccttacttcttaaactttcttgcaagtttgttgac

SEQ ID NO: 226 - DNA, 36 bp, Artificial Sequence
  IFN alpha-2b HindIII Primer
cccaagcttatggccttgacctttgctttactggtg

SEQ ID NO: 227 - DNA, 48 bp, Artificial Sequence; identical to SEQ ID NO: 225
  IFN alpha-2b XbaI Primer

SEQ ID NO: 228 - DNA, 80 bp, Artificial Sequence
  IFN alpha-2b 80 bp 5' Primer
cccaagcttatggccttgacctttgctttactggtggccctcctggtgctcagctgcaagtcaagctgctctgtgggctg

SEQ ID NO: 229 - DNA, 20 bp, Artificial Sequence
  EMCV Forward Primer
cccctacattgaggcatcca

SEQ ID NO: 230 - DNA, 21 bp, Artificial Sequence
  EMCV Reverse Primer
caggagcaggacaaggtcact

SEQ ID NO: 231 - DNA, 22 bp, Artificial Sequence
  EMCV Probe
  FAM attached to 5' end of sequence
  TAMR A attached to 3' end of sequence
cagccgtcaagacccaaccgct

SEQ ID NO: 232 - protein, 165 aa, Artificial Sequence
  Interferon alpha consensus sequence
CDLPQTHSLGNRRALILLAQMRRISPFSCLKDRHDFGPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 233 - protein, 166 aa, Homo sapiens
MSYNLLGFLQRSSNFQCQKLLWQLNGRLEYCLKDRMNFQIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 234 - protein, 166 aa, Homo sapiens; identical to SEQ ID NO: 233

SEQ ID NO: 235 - protein, 166 aa, Homo sapiens
MSYNLLGFLQRSSNFQCQKLLWQLNGRLEYCLKDRMNFHIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 236 - protein, 166 aa, Homo sapiens
MSYNLLGFLQRSSNFQCQKLLWQLNGRLEYCLKDRMNFGIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 237 - protein, 166 aa, Homo sapiens
MSYNLLGFLQRSSNFQCQKLLWQLNGRLEYCLKDRMNFDIPQEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 238 - protein, 166 aa, Homo sapiens
MSYNLLGFLQRSSNFQCQKLLWQLNGRLEYCLKDRMNFDIPHEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 239 - protein, 166 aa, Homo sapiens
MSYNLLGFLQRSSNFQCQKLLWQLNGRLEYCLKDRMNFDIPEEIQQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 240 - protein, 166 aa, Homo sapiens
MSYNLLGFLQRSSNFQCQKLLWQLNGRLEYCLKDRMNFDIPEEITQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 241 - protein, 166 aa, Homo sapiens
MSYNLLGFLQRSSNFQCQKLLWQLNGRLEYCLKDRMNFDIPEEISQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 242 - protein, 166 aa, Homo sapiens
MSYNLLGFLQRSSNFQCQKLLWQLNGRLEYCLKDRMNFDIPEEIHQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 243 - protein, 166 aa, Homo sapiens
MSYNLLGFLQRSSNFQCQKLLWQLNGRLEYCLKDRMNFDIPEEIKQVQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 244 - protein, 166 aa, Homo sapiens
MSYNLLGFLQRSSNFQCQKLLWQLNGRLEYCLKDRMNFDIPEEIKQIQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 245 - protein, 166 aa, Homo sapiens
MSYNLLGFLQRSSNFQCQKLLWQLNGRLEYCLKDRMNFDIPEEIKQTQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 246 - protein, 166 aa, Homo sapiens
MSYNLLGFLQRSSNFQCQKLLWQLNGRLEYCLKDRMNFDIPEEIKQQQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 247 - protein, 166 aa, Homo sapiens
MSYNLLGFLQRSSNFQCQKLLWQLNGRLEYCLKDRMNFDIPEEIKQHQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 248 - protein, 166 aa, Homo sapiens
MSYNLLGFLQRSSNFQCQKLLWQLNGRLEYCLKDRMNFDIPEEIKQAQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 249 - protein, 166 aa, Homo sapiens
MSYNLLGFLQRSSNFQCQKLLWQLNGRLEYCLKDRMNFDIPEEIKQLQQFQQEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 250 - protein, 166 aa, Homo sapiens
MSYNLLGFLQRSSNFQCQKLLWQLNGRLEYCLKDRMNFDIPEEIKQLQQFQTEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 251 - protein, 166 aa, Homo sapiens
MSYNLLGFLQRSSNFQCQKLLWQLNGRLEYCLKDRMNFDIPEEIKQLQQFQSEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 252 - protein, 166 aa, Homo sapiens
MSYNLLGFLQRSSNFQCQKLLWQLNGRLEYCLKDRMNFDIPEEIKQLQQFQHEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 253 - protein, 166 aa, Homo sapiens
MSYNLLGFLQRSSNFQCQKLLWQLNGRLEYCLKDRMNFDIPEEIKQLQQFQKEDAALTIYEMLQNIIAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 254 - protein, 166 aa, Homo sapiens
MSYNLLGFLQRSSNFQCQKLLWQLNGRLEYCLKDRMNFDIPEEIKQLQQFQKEDAALTIYEMLQNIVAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 255 - protein, 166 aa, Homo sapiens
MSYNLLGFLQRSSNFQCQKLLWQLNGRLEYCLKDRMNFDIPEEIKQLQQFQKEDAALTIYEMLQNIFAIFHQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 256 - protein, 166 aa, Homo sapiens
MSYNLLGFLQRSSNFQCQKLLWQLNGRLEYCLKDRMNFDIPEEIKQLQQFQKEDAALTIYEMLQNIFAIFQQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 257 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQQSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 258 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQHSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 259 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQGSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 260 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNQTIVENLLANVYHQINHLKTVLEEKLEKEDFTRGKLMSSLHLKRYYGRILHYLKAKEYSHCAWTIVRVEILRNFYFINRLTGYLRN

SEQ ID NO: 261 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNHTIVENLLANVYHQINHLKTVLEEKLEKEDFTRGKLMSSLHLKRYYGRILHYLKAKEYSHCAWTIVRVEILRNFYFINRLTGYLRN

SEQ ID NO: 262 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLQKEDFTRGKLMSSLHLKRYYGRILHYLKAKEYSHCAWTIVRVEILRNFYFINRLTGYLRN

SEQ ID NO: 263 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLHKEDFTRGKLMSSLHLKRYYGRILHYLKAKEYSHCAWTIVRVEILRNFYFINRLTGYLRN

SEQ ID NO: 264 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEQEDFTRGKLMSSLHLKRYYGRILHYLKAKEYSHCAWTIVRVEILRNFYFINRLTGYLRN

SEQ ID NO: 265 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLETEDFTRGKLMSSLHLKRYYGRILHYLKAKEYSHCAWTIVRVEILRNFYFINRLTGYLRN

SEQ ID NO: 266 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLESEDFTRGKLMSSLHLKRYYGRILHYLKAKEYSHCAWTIVRVEILRNFYFINRLTGYLRN

SEQ ID NO: 267 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEHEDFTRGKLMSSLHLKRYYGRILHYLKAKEYSHCAWTIVRVEILRNFYFINRLTGYLRN

SEQ ID NO: 268 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKQDFTRGKLMSSLHLKRYYGRILHYLKAKEYSHCAWTIVRVEILRNFYFINRLTGYLRN

SEQ ID NO: 269 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKHDFTRGKLMSSLHLKRYYGRILHYLKAKEYSHCAWTIVRVEILRNFYFINRLTGYLRN

SEQ ID NO: 270 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEQFTRGKLMSSLHLKRYYGRILHYLKAKEYSHCAWTIVRVEILRNFYFINRLTGYLRN

SEQ ID NO: 271 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEHFTRGKLMSSLHLKRYYGRILHYLKAKEYSHCAWTIVRVEILRNFYFINRLTGYLRN

SEQ ID NO: 272 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEGFTRGKLMSSLHLKRYYGRILHYLKAKEYSHCAWTIVRVEILRNFYFINRLTGYLRN

SEQ ID NO: 273 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDITRGKLMSSLHLKRYYGRILHYLKAKEYSHCAWTIVRVEILRNFYFINRLTGYLRN

SEQ ID NO: 274 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDVTRGKLMSSLHLKRYYGRILHYLKAKEYSHCAWTIVRVEILRNFYFINRLTGYLRN

SEQ ID NO: 275 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTHGKLMSSLHLKRYYGRILHYLKAKEYSHCAWTIVRVEILRNFYFINRLTGYLRN

SEQ ID NO: 276 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTQGKLMSSLHLKRYYGRILHYLKAKEYSHCAWTIVRVEILRNFYFINRLTGYLRN

SEQ ID NO: 277 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKVMSSLHLKRYYGRILHYLKAKEYSHCAWTIVRVEILRNFYFINRLTGYLRN

SEQ ID NO: 278 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKIMSSLHLKRYYGRILHYLKAKEYSHCAWTIVRVEILRNFYFINRLTGYLRN

SEQ ID NO: 279 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKTMSSLHLKRYYGRILHYLKAKEYSHCAWTIVRVEILRNFYFINRLTGYLRN

SEQ ID NO: 280 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKQMSSLHLKRYYGRILHYLKAKEYSHCAWTIVRVEILRNFYFINRLTGYLRN

SEQ ID NO: 281 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKHMSSLHLKRYYGRILHYLKAKEYSHCAWTIVRVEILRNFYFINRLTGYLRN

SEQ ID NO: 282 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKAMSSLHLKRYYGRILHYLKAKEYSHCAWTIVRVEILRNFYFINRLTGYLRN

SEQ ID NO: 283 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSVHLKRYYGRILHYLKAKEYSHCAWTIVRVEILRNFYFINRLTGYLRN

SEQ ID NO: 284 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSIHLKRYYGRILHYLKAKEYSHCAWTIVRVEILRNFYFINRLTGYLRN

SEQ ID NO: 285 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSTHLKRYYGRILHYLKAKEYSHCAWTIVRVEILRNFYFINRLTGYLRN

SEQ ID NO: 286 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSQHLKRYYGRILHYLKAKEYSHCAWTIVRVEILRNFYFINRLTGYLRN

SEQ ID NO: 287 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSHHLKRYYGRILHYLKAKEYSHCAWTIVRVEILRNFYFINRLTGYLRN

SEQ ID NO: 288 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSAHLKRYYGRILHYLKAKEYSHCAWTIVRVEILRNFYFINRLTGYLRN

SEQ ID NO: 289 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLQRYYGRILHYLKAKEYSHCAWTIVRVEILRNFYFINRLTGYLRN

SEQ ID NO: 290 - protein, 146 aa, Homo sapiens
CYCQDPYVKEAENLKKYFNAGHSDVADNGTLFVGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 291 - protein, 146 aa, Homo sapiens
CYCQDPYVKEAENLKKYFNAGHSDVADNGTLFIGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 292 - protein, 146 aa, Homo sapiens
CYCQDPYVKEAENLKKYFNAGHSDVADNGTLFLGILQNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 293 - protein, 146 aa, Homo sapiens
CYCQDPYVKEAENLKKYFNAGHSDVADNGTLFLGILNNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 294 - protein, 146 aa, Homo sapiens
CYCQDPYVKEAENLKKYFNAGHSDVADNGTLFLGILKNWQEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 295 - protein, 146 aa, Homo sapiens
CYCQDPYVKEAENLKKYFNAGHSDVADNGTLFLGILKNWNEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 296 - protein, 146 aa, Homo sapiens
CYCQDPYVKEAENLKKYFNAGHSDVADNGTLFLGILKNWKQESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 297 - protein, 146 aa, Homo sapiens
CYCQDPYVKEAENLKKYFNAGHSDVADNGTLFLGILKNWKNESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 298 - protein, 146 aa, Homo sapiens
CYCQDPYVKEAENLKKYFNAGHSDVADNGTLFLGILKNWKHESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 299 - protein, 146 aa, Homo sapiens
CYCQDPYVKEAENLKKYFNAGHSDVADNGTLFLGILKNWKEQSDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 300 - protein, 146 aa, Homo sapiens
CYCQDPYVKEAENLKKYFNAGHSDVADNGTLFLGILKNWKENSDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 301 - protein, 146 aa, Homo sapiens
CYCQDPYVKEAENLKKYFNAGHSDVADNGTLFLGILKNWKEHSDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 302 - protein, 146 aa, Homo sapiens
CYCQDPYVKEAENLKKYFNAGHSDVADNGTLFLGILKNWKEESDRKIMQSQIVSFYFQLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 303 - protein, 146 aa, Homo sapiens
CYCQDPYVKEAENLKKYFNAGHSDVADNGTLFLGILKNWKEESDRKIMQSQIVSFYFNLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 304 - protein, 146 aa, Homo sapiens
CYCQDPYVKEAENLKKYFNAGHSDVADNGTLFLGILKNWKEESDRKIMQSQIVSFYFKLFQNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 305 - protein, 146 aa, Homo sapiens
CYCQDPYVKEAENLKKYFNAGHSDVADNGTLFLGILKNWKEESDRKIMQSQIVSFYFKLFNNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 306 - protein, 146 aa, Homo sapiens
CYCQDPYVKEAENLKKYFNAGHSDVADNGTLFLGILKNWKEESDRKIMQSQIVSFYFKLFKNFQDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 307 - protein, 146 aa, Homo sapiens
CYCQDPYVKEAENLKKYFNAGHSDVADNGTLFLGILKNWKEESDRKIMQSQIVSFYFKLFKNFNDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 308 - protein, 146 aa, Homo sapiens
CYCQDPYVKEAENLKKYFNAGHSDVADNGTLFLGILKNWKEESDRKIMQSQIVSFYFKLFKNFKQDQSIQKSVETIKEDMNVKFFNSNKKKRDDFEKLTNYSVTDLNVQRKAIHELIQVMAELSPAAKTGKRKRSQMLFQGRRASQ

SEQ ID NO: 309 - protein, 146 aa, Homo sapiens
CYCQDPYVKEAENLKKYFNAGHSDVADNGTLFLGILKNWKEESDRKIMQSQIVSFYFKLFKNFKNDQSIQKSVETIKEDMNVKFFNSNKKKRDDFEKLTNYSVTDLNVQRKAIHELIQVMAELSPAAKTGKRKRSQMLFQGRRASQ

SEQ ID NO: 310 - protein, 146 aa, Homo sapiens
CYCQDPYVKEAENLKKYFNAGHSDVADNGTLFLGILKNWKEESDRKIMQSQIVSFYFKLFKNFKDQQSIQKSVETIKEDMNVKFFNSNKKKRDDFEKLTNYSVTDLNVQRKAIHELIQVMAELSPAAKTGKRKRSQMLFQGRRASQ

SEQ ID NO: 311 - protein, 146 aa, Homo sapiens
CYCQDPYVKEAENLKKYFNAGHSDVADNGTLFLGILKNWKEESDRKIMQSQIVSFYFKLFKNFKDNQSIQKSVETIKEDMNVKFFNSNKKKRDDFEKLTNYSVTDLNVQRKAIHELIQVMAELSPAAKTGKRKRSQMLFQGRRASQ

SEQ ID NO: 312 - protein, 160 aa, Homo sapiens
SPGQGTQSENSCTHFPGNLPNMLRDLRDAFSRVKTFFQMKDQLDNLLLQESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 313 - protein, 160 aa, Homo sapiens
SPGQGTQSENSCTHFPGNLPNMLRDLRDAFSRVKTFFQMKDQLDNLLLNESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 314 - protein, 160 aa, Homo sapiens
SPGQGTQSENSCTHFPGNLPNMLRDLRDAFSRVKTFFQMKDQLDNLLLKQSLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 315 - protein, 160 aa, Homo sapiens
SPGQGTQSENSCTHFPGNLPNMLRDLRDAFSRVKTFFQMKDQLDNLLLKNSLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 316 - protein, 160 aa, Homo sapiens
SPGQGTQSENSCTHFPGNLPNMLRDLRDAFSRVKTFFQMKDQLDNLLLKHSLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 317 - protein, 160 aa, Homo sapiens
SPGQGTQSENSCTHFPGNLPNMLRDLRDAFSRVKTFFQMKDQLDNLLLKESVLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 318 - protein, 160 aa, Homo sapiens
SPGQGTQSENSCTHFPGNLPNMLRDLRDAFSRVKTFFQMKDQLDNLLLKESILEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 319 - protein, 160 aa, Homo sapiens
SPGQGTQSENSCTHFPGNLPNMLRDLRDAFSRVKTFFQMKDQLDNLLLKESLVEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 320 - protein, 160 aa, Homo sapiens
SPGQGTQSENSCTHFPGNLPNMLRDLRDAFSRVKTFFQMKDQLDNLLLKESLIEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 321 - protein, 160 aa, Homo sapiens
SPGQGTQSENSCTHFPGNLPNMLRDLRDAFSRVKTFFQMKDQLDNLLLKESLLQDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 322 - protein, 160 aa, Homo sapiens
SPGQGTQSENSCTHFPGNLPNMLRDLRDAFSRVKTFFQMKDQLDNLLLKESLLNDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 323 - protein, 160 aa, Homo sapiens
SPGQGTQSENSCTHFPGNLPNMLRDLRDAFSRVKTFFQMKDQLDNLLLKESLLHDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 324 - protein, 160 aa, Homo sapiens
SPGQGTQSENSCTHFPGNLPNMLRDLRDAFSRVKTFFQMKDQLDNLLLKESLLEQFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 325 - protein, 160 aa, Homo sapiens
SPGQGTQSENSCTHFPGNLPNMLRDLRDAFSRVKTFFQMKDQLDNLLLKESLLENFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 326 - protein, 160 aa, Homo sapiens
SPGQGTQSENSCTHFPGNLPNMLRDLRDAFSRVKTFFQMKDQLDNLLLKESLLEDIKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 327 - protein, 160 aa, Homo sapiens
SPGQGTQSENSCTHFPGNLPNMLRDLRDAFSRVKTFFQMKDQLDNLLLKESLLEDVKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 328 - protein, 160 aa, Homo sapiens
SPGQGTQSENSCTHFPGNLPNMLRDLRDAFSRVKTFFQMKDQLDNLLLKESLLEDFQGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 329 - protein, 160 aa, Homo sapiens
SPGQGTQSENSCTHFPGNLPNMLRDLRDAFSRVKTFFQMKDQLDNLLLKESLLEDFNGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 330 - protein, 160 aa, Homo sapiens
SPGQGTQSENSCTHFPGNLPNMLRDLRDAFSRVKTFFQMKDQLDNLLLKESLLEDFKGHLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 331 - protein, 160 aa, Homo sapiens
SPGQGTQSENSCTHFPGNLPNMLRDLRDAFSRVKTFFQMKDQLDNLLLKESLLEDFKGILGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 332 - protein, 160 aa, Homo sapiens
SPGQGTQSENSCTHFPGNLPNMLRDLRDAFSRVKTFFQMKDQLDNLLLKESLLEDFKGYVGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 333 - protein, 160 aa, Homo sapiens
SPGQGTQSENSCTHFPGNLPNMLRDLRDAFSRVKTFFQMKDQLDNLLLKESLLEDFKGYIGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 334 - protein, 160 aa, Homo sapiens
SPGQGTQSENSCTHFPGNLPNMLRDLRDAFSRVKTFFQMKDQLDNLLLKESLLEDFKGYLGCQALSQMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 335 - protein, 160 aa, Homo sapiens
SPGQGTQSENSCTHFPGNLPNMLRDLRDAFSRVKTFFQMKDQLDNLLLKESLLEDFKGYLGCQALSNMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 336 - protein, 160 aa, Homo sapiens
SPGQGTQSENSCTHFPGNLPNMLRDLRDAFSRVKTFFQMKDQLDNLLLKESLLEDFKGYLGCQALSHMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 337 - protein, 160 aa, Homo sapiens
SPGQGTQSENSCTHFPGNLPNMLRDLRDAFSRVKTFFQMKDQLDNLLLKESLLEDFKGYLGCQALSEVIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 338 - protein, 160 aa, Homo sapiens
SPGQGTQSENSCTHFPGNLPNMLRDLRDAFSRVKTFFQMKDQLDNLLLKESLLEDFKGYLGCQALSEIIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 339 - protein, 160 aa, Homo sapiens
SPGQGTQSENSCTHFPGNLPNMLRDLRDAFSRVKTFFQMKDQLDNLLLKESLLEDFKGYLGCQALSEMIQIYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 340 - protein, 160 aa, Homo sapiens
SPGQGTQSENSCTHFPGNLPNMLRDLRDAFSRVKTFFQMKDQLDNLLLKESLLEDFKGYLGCQALSEMIQVYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 341 - protein, 160 aa, Homo sapiens
SPGQGTQSENSCTHFPGNLPNMLRDLRDAFSRVKTFFQMKDQLDNLLLKESLLEDFKGYLGCQALSEMIQFHLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 342 - protein, 160 aa, Homo sapiens
SPGQGTQSENSCTHFPGNLPNMLRDLRDAFSRVKTFFQMKDQLDNLLLKESLLEDFKGYLGCQALSEMIQFILEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 343 - protein, 160 aa, Homo sapiens
SPGQGTQSENSCTHFPGNLPNMLRDLRDAFSRVKTFFQMKDQLDNLLLKESLLEDFKGYLGCQALSEMIQFYLQEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 344 - protein, 160 aa, Homo sapiens
SPGQGTQSENSCTHFPGNLPNMLRDLRDAFSRVKTFFQMKDQLDNLLLKESLLEDFKGYLGCQALSEMIQFYLNEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 345 - protein, 160 aa, Homo sapiens
SPGQGTQSENSCTHFPGNLPNMLRDLRDAFSRVKTFFQMKDQLDNLLLKESLLEDFKGYLGCQALSEMIQFYLHEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 346 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEQVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 347 - protein, 160 aa, Homo sapiens
SPGQGTQSENSCTHFPGNLPNMLRDLRDAFSRVKTFFQMKDQLDNLLLKESLLEDFKGYLGCQALSEMIQFYLENVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 348 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEHVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 349 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMSQAENQDPDIKAHVNSLGENLKTLRLRLRRCHRFLPCENKSKAVEQVKNAFNKLQEKGIYKAMSEFDIFINYIEAYMTMKIRN

SEQ ID NO: 350 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMAQAENQDPDIKAHVNSLGENLKTLRLRLRRCHRFLPCENKSKAVEQVKNAFNKLQEKGIYKAMSEFDIFINYIEAYMTMKIRN

SEQ ID NO: 351 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAQNQDPDIKAHVNSLGENLKTLRLRLRRCHRFLPCENKSKAVEQVKNAFNKLQEKGIYKAMSEFDIFINYIEAYMTMKIRN

SEQ ID NO: 352 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQANNQDPDIKAHVNSLGENLKTLRLRLRRCHRFLPCENKSKAVEQVKNAFNKLQEKGIYKAMSEFDIFINYIEAYMTMKIRN

SEQ ID NO: 353 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAHNQDPDIKAHVNSLGENLKTLRLRLRRCHRFLPCENKSKAVEQVKNAFNKLQEKGIYKAMSEFDIFINYIEAYMTMKIRN

SEQ ID NO: 354 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQQPDIKAHVNSLGENLKTLRLRLRRCHRFLPCENKSKAVEQVKNAFNKLQEKGIYKAMSEFDIFINYIEAYMTMKIRN

SEQ ID NO: 355 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQNPDIKAHVNSLGENLKTLRLRLRRCHRFLPCENKSKAVEQVKNAFNKLQEKGIYKAMSEFDIFINYIEAYMTMKIRN

SEQ ID NO: 356 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDSDIKAHVNSLGENLKTLRLRLRRCHRFLPCENKSKAVEQVKNAFNKLQEKGIYKAMSEFDIFINYIEAYMTMKIRN

SEQ ID NO: 357 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDADIKAHVNSLGENLKTLRLRLRRCHRFLPCENKSKAVEQVKNAFNKLQEKGIYKAMSEFDIFINYIEAYMTMKIRN

SEQ ID NO: 358 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPQIKAHVNSLGENLKTLRLRLRRCHRFLPCENKSKAVEQVKNAFNKLQEKGIYKAMSEFDIFINYIEAYMTMKIRN

SEQ ID NO: 359 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPNIKAHVNSLGENLKTLRLRLRRCHRFLPCENKSKAVEQVKNAFNKLQEKGIYKAMSEFDIFINYIEAYMTMKIRN

SEQ ID NO: 360 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIQAHVNSLGENLKTLRLRLRRCHRFLPCENKSKAVEQVKNAFNKLQEKGIYKAMSEFDIFINYIEAYMTMKIRN

SEQ ID NO: 361 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDINAHVNSLGENLKTLRLRLRRCHRFLPCENKSKAVEQVKNAFNKLQEKGIYKAMSEFDIFINYIEAYMTMKIRN

SEQ ID NO: 362 - protein, 127 aa, Homo sapiens
APARSPSPSTQPWEHVNAIQEARRLLNLSRDTAAEMNQTVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 363 - protein, 127 aa, Homo sapiens
APARSPSPSTQPWEHVNAIQEARRLLNLSRDTAAEMNNTVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 364 - protein, 127 aa, Homo sapiens
APARSPSPSTQPWEHVNAIQEARRLLNLSRDTAAEMNHTVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 365 - protein, 127 aa, Homo sapiens
APARSPSPSTQPWEHVNAIQEARRLLNLSRDTAAEMNETVQVISEMFDLQEPTCLQTRLELYKQGLRGSLTKLKGPLTMMASHYKQHCPPTPETSCATQIITFESFKENLKDFLLVIPFDCWEPVQE

SEQ ID NO: 366 - protein, 127 aa, Homo sapiens
APARSPSPSTQPWEHVNAIQEARRLLNLSRDTAAEMNETVNVISEMFDLQEPTCLQTRLELYKQGLRGSLTKLKGPLTMMASHYKQHCPPTPETSCATQIITFESFKENLKDFLLVIPFDCWEPVQE

SEQ ID NO: 367 - protein, 127 aa, Homo sapiens
APARSPSPSTQPWEHVNAIQEARRLLNLSRDTAAEMNETVHVISEMFDLQEPTCLQTRLELYKQGLRGSLTKLKGPLTMMASHYKQHCPPTPETSCATQIITFESFKENLKDFLLVIPFDCWEPVQE

SEQ ID NO: 368 - protein, 127 aa, Homo sapiens
APARSPSPSTQPWEHVNAIQEARRLLNLSRDTAAEMNETVEVISQMFDLQEPTCLQTRLELYKQGLRGSLTKLKGPLTMMASHYKQHCPPTPETSCATQIITFESFKENLKDFLLVIPFDCWEPVQE

SEQ ID NO: 369 - protein, 127 aa, Homo sapiens
APARSPSPSTQPWEHVNAIQEARRLLNLSRDTAAEMNETVEVISNMFDLQEPTCLQTRLELYKQGLRGSLTKLKGPLTMMASHYKQHCPPTPETSCATQIITFESFKENLKDFLLVIPFDCWEPVQE

SEQ ID NO: 370 - protein, 127 aa, Homo sapiens
APARSPSPSTQPWEHVNAIQEARRLLNLSRDTAAEMNETVEVISHMFDLQEPTCLQTRLELYKQGLRGSLTKLKGPLTMMASHYKQHCPPTPETSCATQIITFESFKENLKDFLLVIPFDCWEPVQE

SEQ ID NO: 371 - protein, 127 aa, Homo sapiens
APARSPSPSTQPWEHVNAIQEARRLLNLSRDTAAEMNETVEVISEVFDLQEPTCLQTRLELYKQGLRGSLTKLKGPLTMMASHYKQHCPPTPETSCATQIITFESFKENLKDFLLVIPFDCWEPVQE

SEQ ID NO: 372 - protein, 127 aa, Homo sapiens
APARSPSPSTQPWEHVNAIQEARRLLNLSRDTAAEMNETVEVISEIFDLQEPTCLQTRLELYKQGLRGSLTKLKGPLTMMASHYKQHCPPTPETSCATQIITFESFKENLKDFLLVIPFDCWEPVQE

SEQ ID NO: 373 - protein, 127 aa, Homo sapiens
APARSPSPSTQPWEHVNAIQEARRLLNLSRDTAAEMNETVEVISEMFQLQEPTCLQTRLELYKQGLRGSLTKLKGPLTMMASHYKQHCPPTPETSCATQIITFESFKENLKDFLLVIPFDCWEPVQE

SEQ ID NO: 374 - protein, 127 aa, Homo sapiens
APARSPSPSTQPWEHVNAIQEARRLLNLSRDTAAEMNETVEVISEMFNLQEPTCLQTRLELYKQGLRGSLTKLKGPLTMMASHYKQHCPPTPETSCATQIITFESFKENLKDFLLVIPFDCWEPVQE

SEQ ID NO: 375 - protein, 127 aa, Homo sapiens
APARSPSPSTQPWEHVNAIQEARRLLNLSRDTAAEMNETVEVISEMFDVQEPTCLQTRLELYKQGLRGSLTKLKGPLTMMASHYKQHCPPTPETSCATQIITFESFKENLKDFLLVIPFDCWEPVQE

SEQ ID NO: 376 - protein, 127 aa, Homo sapiens
APARSPSPSTQPWEHVNAIQEARRLLNLSRDTAAEMNETVEVISEMFDIQEPTCLQTRLELYKQGLRGSLTKLKGPLTMMASHYKQHCPPTPETSCATQIITFESFKENLKDFLLVIPFDCWEPVQE

SEQ ID NO: 377 - protein, 127 aa, Homo sapiens
APARSPSPSTQPWEHVNAIQEARRLLNLSRDTAAEMNETVEVISEMFDLQQPTCLQTRLELYKQGLRGSLTKLKGPLTMMASHYKQHCPPTPETSCATQIITFESFKENLKDFLLVIPFDCWEPVQE

SEQ ID NO: 378 - protein, 127 aa, Homo sapiens
APARSPSPSTQPWEHVNAIQEARRLLNLSRDTAAEMNETVEVISEMFDLQNPTCLQTRLELYKQGLRGSLTKLKGPLTMMASHYKQHCPPTPETSCATQIITFESFKENLKDFLLVIPFDCWEPVQE

SEQ ID NO: 379 - protein, 127 aa, Homo sapiens
APARSPSPSTQPWEHVNAIQEARRLLNLSRDTAAEMNETVEVISEMFDLQHPTCLQTRLELYKQGLRGSLTKLKGPLTMMASHYKQHCPPTPETSCATQIITFESFKENLKDFLLVIPFDCWEPVQE

SEQ ID NO: 380 - protein, 127 aa, Homo sapiens
APARSPSPSTQPWEHVNAIQEARRLLNLSRDTAAEMNETVEVISEMFDLQEPTCLQTRLQLYKQGLRGSLTKLKGPLTMMASHYKQHCPPTPETSCATQIITFESFKENLKDFLLVIPFDCWEPVQE

SEQ ID NO: 381 - protein, 127 aa, Homo sapiens
APARSPSPSTQPWEHVNAIQEARRLLNLSRDTAAEMNETVEVISEMFDLQEPTCLQTRLNLYKQGLRGSLTKLKGPLTMMASHYKQHCPPTPETSCATQIITFESFKENLKDFLLVIPFDCWEPVQE

SEQ ID NO: 382 - protein, 127 aa, Homo sapiens
APARSPSPSTQPWEHVNAIQEARRLLNLSRDTAAEMNETVEVISEMFDLQEPTCLQTRLHLYKQGLRGSLTKLKGPLTMMASHYKQHCPPTPETSCATQIITFESFKENLKDFLLVIPFDCWEPVQE

SEQ ID NO: 383 - protein, 127 aa, Homo sapiens
APARSPSPSTQPWEHVNAIQEARRLLNLSRDTAAEMNETVEVISEMFDLQEPTCLQTRLELYQQGLRGSLTKLKGPLTMMASHYKQHCPPTPETSCATQIITFESFKENLKDFLLVIPFDCWEPVQE

SEQ ID NO: 384 - protein, 127 aa, Homo sapiens
APARSPSPSTQPWEHVNAIQEARRLLNLSRDTAAEMNETVEVISEMFDLQEPTCLQTRLELYNQGLRGSLTKLKGPLTMMASHYKQHCPPTPETSCATQIITFESFKENLKDFLLVIPFDCWEPVQE

SEQ ID NO: 385 - protein, 127 aa, Homo sapiens
APARSPSPSTQPWEHVNAIQEARRLLNLSRDTAAEMNETVEVISEMFDLQEPTCLQTRLELYKQGLHGSLTKLKGPLTMMASHYKQHCPPTPETSCATQIITFESFKENLKDFLLVIPFDCWEPVQE

SEQ ID NO: 386 - protein, 127 aa, Homo sapiens
APARSPSPSTQPWEHVNAIQEARRLLNLSRDTAAEMNETVEVISEMFDLQEPTCLQTRLELYKQGLQGSLTKLKGPLTMMASHYKQHCPPTPETSCATQIITFESFKENLKDFLLVIPFDCWEPVQE

SEQ ID NO: 387 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTSETSCATQIITFESFKENLKDFLLVIPFDCWEPVQE

SEQ ID NO: 388 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTAETSCATQIITFESFKENLKDFLLVIPFDCWEPVQE

SEQ ID NO: 389 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPQTSCATQIITFESFKENLKDFLLVIPFDCWEPVQE

SEQ ID NO: 390 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPNTSCATQIITFESFKENLKDFLLVIPFDCWEPVQE

SEQ ID NO: 391 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPHTSCATQIITFESFKENLKDFLLVIPFDCWEPVQE

SEQ ID NO: 392 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPIDCWEPVQE

SEQ ID NO: 393 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPVDCWEPVQE

SEQ ID NO: 394 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFQCWEPVQE

SEQ ID NO: 395 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFNCWEPVQE

SEQ ID NO: 396 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWQPVQE

SEQ ID NO: 397 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWNPVQE

SEQ ID NO: 398 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWHPVQE

SEQ ID NO: 399 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWESVQE

SEQ ID NO: 400 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEAVQE

SEQ ID NO: 401 - protein, 209 aa, Homo sapiens
TQQCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 402 - protein, 209 aa, Homo sapiens
TQNCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 403 - protein, 209 aa, Homo sapiens
TQDCSFQHSPISSDFAVKIRELSDYLLQDYPVTVASNLQQEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 404 - protein, 209 aa, Homo sapiens
TQDCSFQHSPISSDFAVKIRELSDYLLQDYPVTVASNLQNEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 405 - protein, 209 aa, Homo sapiens
TQDCSFQHSPISSDFAVKIRELSDYLLQDYPVTVASNLQDEQLCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 406 - protein, 209 aa, Homo sapiens
TQDCSFQHSPISSDFAVKIRELSDYLLQDYPVTVASNLQDENLCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 407 - protein, 209 aa, Homo sapiens
TQDCSFQHSPISSDFAVKIRELSDYLLQDYPVTVASNLQDEHLCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 408 - protein, 209 aa, Homo sapiens
TQDCSFQHSPISSDFAVKIRELSDYLLQDYPVTVASNLQDEEVCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 409 - protein, 209 aa, Homo sapiens
TQDCSFQHSPISSDFAVKIRELSDYLLQDYPVTVASNLQDEEICGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 410 - protein, 209 aa, Homo sapiens
TQDCSFQHSPISSDFAVKIRELSDYLLQDYPVTVASNLQDEELCGGLWRLVLAQHWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 411 - protein, 209 aa, Homo sapiens
TQDCSFQHSPISSDFAVKIRELSDYLLQDYPVTVASNLQDEELCGGLWRLVLAQQWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 412 - protein, 209 aa, Homo sapiens
TQDCSFQHSPISSDFAVKIRELSDYLLQDYPVTVASNLQDEELCGGLWRLVLAQRWMQRLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 413 - protein, 209 aa, Homo sapiens
TQDCSFQHSPISSDFAVKIRELSDYLLQDYPVTVASNLQDEELCGGLWRLVLAQRWMNRLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 414 - protein, 209 aa, Homo sapiens
TQDCSFQHSPISSDFAVKIRELSDYLLQDYPVTVASNLQDEELCGGLWRLVLAQRWMHRLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 415 - protein, 209 aa, Homo sapiens
TQDCSFQHSPISSDFAVKIRELSDYLLQDYPVTVASNLQDEELCGGLWRLVLAQRWMEHLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 416 - protein, 209 aa, Homo sapiens
TQDCSFQHSPISSDFAVKIRELSDYLLQDYPVTVASNLQDEELCGGLWRLVLAQRWMEQLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 417 - protein, 209 aa, Homo sapiens
TQDCSFQHSPISSDFAVKIRELSDYLLQDYPVTVASNLQDEELCGGLWRLVLAQRWMERLQTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 418 - protein, 209 aa, Homo sapiens
TQDCSFQHSPISSDFAVKIRELSDYLLQDYPVTVASNLQDEELCGGLWRLVLAQRWMERLNTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 419 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQSPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 420 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQAPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 421 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQPSPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 422 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQPAPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 423 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQPPSSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 424 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQPPASCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 425 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQPPPSCLHFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 426 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQPPPSCLQFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 427 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQPPPSCLRIVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 428 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQPPPSCLRVVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 429 - protein, 133 aa, Homo sapiens
APTSSSTKKTQLQLEHLLLDLQMILNGINNYKNPKLTRMLTFQFYMPKKATELKHLQCLEEELKPLEEVLNLAQSKNFHLRPRDLISNINVIVLELKGSETTFMCEYADETATIVEFLNRWITFCQSIISTLT

SEQ ID NO: 430 - protein, 133 aa, Homo sapiens
APTSSSTKKTQLQLEHLLLDLQMILNGINNYKNPKLTRMLTFNFYMPKKATELKHLQCLEEELKPLEEVLNLAQSKNFHLRPRDLISNINVIVLELKGSETTFMCEYADETATIVEFLNRWITFCQSIISTLT

SEQ ID NO: 431 - protein, 133 aa, Homo sapiens
APTSSSTKKTQLQLEHLLLDLQMILNGINNYKNPKLTRMLTFKFHMPKKATELKHLQCLEEELKPLEEVLNLAQSKNFHLRPRDLISNINVIVLELKGSETTFMCEYADETATIVEFLNRWITFCQSIISTLT

SEQ ID NO: 432 - protein, 133 aa, Homo sapiens
APTSSSTKKTQLQLEHLLLDLQMILNGINNYKNPKLTRMLTFKFIMPKKATELKHLQCLEEELKPLEEVLNLAQSKNFHLRPRDLISNINVIVLELKGSETTFMCEYADETATIVEFLNRWITFCQSIISTLT

SEQ ID NO: 433 - protein, 133 aa, Homo sapiens
APTSSSTKKTQLQLEHLLLDLQMILNGINNYKNPKLTRMLTFKFYMPQKATELKHLQCLEEELKPLEEVLNLAQSKNFHLRPRDLISNINVIVLELKGSETTFMCEYADETATIVEFLNRWITFCQSIISTLT

SEQ ID NO: 434 - protein, 133 aa, Homo sapiens
APTSSSTKKTQLQLEHLLLDLQMILNGINNYKNPKLTRMLTFKFYMPNKATELKHLQCLEEELKPLEEVLNLAQSKNFHLRPRDLISNINVIVLELKGSETTFMCEYADETATIVEFLNRWITFCQSIISTLT

SEQ ID NO: 435 - protein, 133 aa, Homo sapiens
APTSSSTKKTQLQLEHLLLDLQMILNGINNYKNPKLTRMLTFKFYMPKQATELKHLQCLEEELKPLEEVLNLAQSKNFHLRPRDLISNINVIVLELKGSETTFMCEYADETATIVEFLNRWITFCQSIISTLT

SEQ ID NO: 436 - protein, 133 aa, Homo sapiens
APTSSSTKKTQLQLEHLLLDLQMILNGINNYKNPKLTRMLTFKFYMPKNATELKHLQCLEEELKPLEEVLNLAQSKNFHLRPRDLISNINVIVLELKGSETTFMCEYADETATIVEFLNRWITFCQSIISTLT

SEQ ID NO: 437 - protein, 133 aa, Homo sapiens
APTSSSTKKTQLQLEHLLLDLQMILNGINNYKNPKLTRMLTFKFYMPKKATQLKHLQCLEEELKPLEEVLNLAQSKNFHLRPRDLISNINVIVLELKGSETTFMCEYADETATIVEFLNRWITFCQSIISTLT

SEQ ID NO: 438 - protein, 133 aa, Homo sapiens
APTSSSTKKTQLQLEHLLLDLQMILNGINNYKNPKLTRMLTFKFYMPKKATNLKHLQCLEEELKPLEEVLNLAQSKNFHLRPRDLISNINVIVLELKGSETTFMCEYADETATIVEFLNRWITFCQSIISTLT

SEQ ID NO: 439 - protein, 133 aa, Homo sapiens
APTSSSTKKTQLQLEHLLLDLQMILNGINNYKNPKLTRMLTFKFYMPKKATHLKHLQCLEEELKPLEEVLNLAQSKNFHLRPRDLISNINVIVLELKGSETTFMCEYADETATIVEFLNRWITFCQSIISTLT

SEQ ID NO: 440 - protein, 133 aa, Homo sapiens
APTSSSTKKTQLQLEHLLLDLQMILNGINNYKNPKLTRMLTFKFYMPKKATEVKHLQCLEEELKPLEEVLNLAQSKNFHLRPRDLISNINVIVLELKGSETTFMCEYADETATIVEFLNRWITFCQSIISTLT

SEQ ID NO: 441 - protein, 133 aa, Homo sapiens
APTSSSTKKTQLQLEHLLLDLQMILNGINNYKNPKLTRMLTFKFYMPKKATEIKHLQCLEEELKPLEEVLNLAQSKNFHLRPRDLISNINVIVLELKGSETTFMCEYADETATIVEFLNRWITFCQSIISTLT

SEQ ID NO: 442 - protein, 133 aa, Homo sapiens
APTSSSTKKTQLQLEHLLLDLQMILNGINNYKNPKLTRMLTFKFYMPKKATELKHLQCLQEELKPLEEVLNLAQSKNFHLRPRDLISNINVIVLELKGSETTFMCEYADETATIVEFLNRWITFCQSIISTLT

SEQ ID NO: 443 - protein, 133 aa, Homo sapiens
APTSSSTKKTQLQLEHLLLDLQMILNGINNYKNPKLTRMLTFKFYMPKKATELKHLQCLNEELKPLEEVLNLAQSKNFHLRPRDLISNINVIVLELKGSETTFMCEYADETATIVEFLNRWITFCQSIISTLT

SEQ ID NO: 444 - protein, 133 aa, Homo sapiens
APTSSSTKKTQLQLEHLLLDLQMILNGINNYKNPKLTRMLTFKFYMPKKATELKHLQCLHEELKPLEEVLNLAQSKNFHLRPRDLISNINVIVLELKGSETTFMCEYADETATIVEFLNRWITFCQSIISTLT

SEQ ID NO: 445 - protein, 133 aa, Homo sapiens
APTSSSTKKTQLQLEHLLLDLQMILNGINNYKNPKLTRMLTFKFYMPKKATELKHLQCLEQELKPLEEVLNLAQSKNFHLRPRDLISNINVIVLELKGSETTFMCEYADETATIVEFLNRWITFCQSIISTLT

SEQ ID NO: 446 - protein, 133 aa, Homo sapiens
APTSSSTKKTQLQLEHLLLDLQMILNGINNYKNPKLTRMLTFKFYMPKKATELKHLQCLENELKPLEEVLNLAQSKNFHLRPRDLISNINVIVLELKGSETTFMCEYADETATIVEFLNRWITFCQSIISTLT

SEQ ID NO: 447 - protein, 133 aa, Homo sapiens
APTSSSTKKTQLQLEHLLLDLQMILNGINNYKNPKLTRMLTFKFYMPKKATELKHLQCLEHELKPLEEVLNLAQSKNFHLRPRDLISNINVIVLELKGSETTFMCEYADETATIVEFLNRWITFCQSIISTLT

SEQ ID NO: 448 - protein, 133 aa, Homo sapiens
APTSSSTKKTQLQLEHLLLDLQMILNGINNYKNPKLTRMLTFKFYMPKKATELKHLQCLEEELKSLEEVLNLAQSKNFHLRPRDLISNINVIVLELKGSETTFMCEYADETATIVEFLNRWITFCQSIISTLT

SEQ ID NO: 449 - protein, 133 aa, Homo sapiens
APTSSSTKKTQLQLEHLLLDLQMILNGINNYKNPKLTRMLTFKFYMPKKATELKHLQCLEEELKALEEVLNLAQSKNFHLRPRDLISNINVIVLELKGSETTFMCEYADETATIVEFLNRWITFCQSIISTLT

SEQ ID NO: 450 - protein, 133 aa, Homo sapiens
APTSSSTKKTQLQLEHLLLDLQMILNGINNYKNPKLTRMLTFKFYMPKKATELKHLQCLEEELKPLQEVLNLAQSKNFHLRPRDLISNINVIVLELKGSETTFMCEYADETATIVEFLNRWITFCQSIISTLT

SEQ ID NO: 451 - protein, 133 aa, Homo sapiens
APTSSSTKKTQLQLEHLLLDLQMILNGINNYKNPKLTRMLTFKFYMPKKATELKHLQCLEEELKPLNEVLNLAQSKNFHLRPRDLISNINVIVLELKGSETTFMCEYADETATIVEFLNRWITFCQSIISTLT

SEQ ID NO: 452 - protein, 133 aa, Homo sapiens
APTSSSTKKTQLQLEHLLLDLQMILNGINNYKNPKLTRMLTFKFYMPKKATELKHLQCLEEELKPLHEVLNLAQSKNFHLRPRDLISNINVIVLELKGSETTFMCEYADETATIVEFLNRWITFCQSIISTLT

SEQ ID NO: 453 - protein, 133 aa, Homo sapiens
APTSSSTKKTQLQLEHLLLDLQMILNGINNYKNPKLTRMLTFKFYMPKKATELKHLQCLEEELKPLEQVLNLAQSKNFHLRPRDLISNINVIVLELKGSETTFMCEYADETATIVEFLNRWITFCQSIISTLT

SEQ ID NO: 454 - protein, 133 aa, Homo sapiens
APTSSSTKKTQLQLEHLLLDLQMILNGINNYKNPKLTRMLTFKFYMPKKATELKHLQCLEEELKPLENVLNLAQSKNFHLRPRDLISNINVIVLELKGSETTFMCEYADETATIVEFLNRWITFCQSIISTLT

SEQ ID NO: 455 - protein, 133 aa, Homo sapiens
APTSSSTKKTQLQLEHLLLDLQMILNGINNYKNPKLTRMLTFKFYMPKKATELKHLQCLEEELKPLEHVLNLAQSKNFHLRPRDLISNINVIVLELKGSETTFMCEYADETATIVEFLNRWITFCQSIISTLT

SEQ ID NO: 456 - protein, 133 aa, Homo sapiens
APTSSSTKKTQLQLEHLLLDLQMILNGINNYKNPKLTRMLTFKFYMPKKATELKHLQCLEEELKPLEEVLNVAQSKNFHLRPRDLISNINVIVLELKGSETTFMCEYADETATIVEFLNRWITFCQSIISTLT

SEQ ID NO: 457 - protein, 133 aa, Homo sapiens
APTSSSTKKTQLQLEHLLLDLQMILNGINNYKNPKLTRMLTFKFYMPKKATELKHLQCLEEELKPLEEVLNIAQSKNFHLRPRDLISNINVIVLELKGSETTFMCEYADETATIVEFLNRWITFCQSIISTLT

SEQ ID NO: 458 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSQTTFMCEYADETATIVEFLNRWITFCQSIISTLT

SEQ ID NO: 459 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSNTTFMCEYADETATIVEFLNRWITFCQSIISTLT

SEQ ID NO: 460 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSHTTFMCEYADETATIVEFLNRWITFCQSIISTLT

SEQ ID NO: 461 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTIMCEYADETATIVEFLNRWITFCQSIISTLT

SEQ ID NO: 462 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTVMCEYADETATIVEFLNRWITFCQSIISTLT

SEQ ID NO: 463 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFVCEYADETATIVEFLNRWITFCQSIISTLT

SEQ ID NO: 464 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFICEYADETATIVEFLNRWITFCQSIISTLT

SEQ ID NO: 465 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCQYADETATIVEFLNRWITFCQSIISTLT

SEQ ID NO: 466 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCNYADETATIVEFLNRWITFCQSIISTLT

SEQ ID NO: 467 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCHYADETATIVEFLNRWITFCQSIISTLT

SEQ ID NO: 468 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEHADETATIVEFLNRWITFCQSIISTLT

SEQ ID NO: 469 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEIADETATIVEFLNRWITFCQSIISTLT

SEQ ID NO: 470 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYAQETATIVEFLNRWITFCQSIISTLT

SEQ ID NO: 471 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYANETATIVEFLNRWITFCQSIISTLT

SEQ ID NO: 472 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADQTATIVEFLNRWITFCQSIISTLT

SEQ ID NO: 473 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADNTATIVEFLNRWITFCQSIISTLT

SEQ ID NO: 474 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADHTATIVEFLNRWITFCQSIISTLT

SEQ ID NO: 475 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTVT

SEQ ID NO: 476 - protein, 133 aa, Homo sapiens
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTIT

SEQ ID NO: 477 - protein, 133 aa, Homo sapiens
APMTQTTPLKTSWVNCSNMIDEIITHLKQPPLPLLDINNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 478 - protein, 133 aa, Homo sapiens
APMTQTTPLKTSWVNCSNMIDEIITHLKQPPLPLLDVNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 479 - protein, 133 aa, Homo sapiens
APMTQTTPLKTSWVNCSNMIDEIITHLKQPPLPLLDFNNLNGQDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 480 - protein, 133 aa, Homo sapiens
APMTQTTPLKTSWVNCSNMIDEIITHLKQPPLPLLDFNNLNGNDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 481 - protein, 133 aa, Homo sapiens
APMTQTTPLKTSWVNCSNMIDEIITHLKQPPLPLLDFNNLNGHDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 482 - protein, 133 aa, Homo sapiens
APMTQTTPLKTSWVNCSNMIDEIITHLKQPPLPLLDFNNLNGEDQQILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 483 - protein, 133 aa, Homo sapiens
APMTQTTPLKTSWVNCSNMIDEIITHLKQPPLPLLDFNNLNGEDQNILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 484 - protein, 133 aa, Homo sapiens
APMTQTTPLKTSWVNCSNMIDEIITHLKQPPLPLLDFNNLNGEDQDILMENNLRRPNLQAFNRAVKSLQNASAIESILKNLLPCLPLATAAPTRHPIHIKDGDWNEFRRKLTFYLKTLENAQAQQTTLSLAIF

SEQ ID NO: 485 - protein, 133 aa, Homo sapiens
APMTQTTPLKTSWVNCSNMIDEIITHLKQPPLPLLDFNNLNGEDQDILMENNLRRPNLNAFNRAVKSLQNASAIESILKNLLPCLPLATAAPTRHPIHIKDGDWNEFRRKLTFYLKTLENAQAQQTTLSLAIF

SEQ ID NO: 486 - protein, 133 aa, Homo sapiens
APMTQTTPLKTSWVNCSNMIDEIITHLKQPPLPLLDFNNLNGEDQDILMENNLRRPNLHAFNRAVKSLQNASAIESILKNLLPCLPLATAAPTRHPIHIKDGDWNEFRRKLTFYLKTLENAQAQQTTLSLAIF

SEQ ID NO: 487 - protein, 133 aa, Homo sapiens
APMTQTTPLKTSWVNCSNMIDEIITHLKQPPLPLLDFNNLNGEDQDILMENNLRRPNLEAFNHAVKSLQNASAIESILKNLLPCLPLATAAPTRHPIHIKDGDWNEFRRKLTFYLKTLENAQAQQTTLSLAIF

SEQ ID NO: 488 - protein, 133 aa, Homo sapiens
APMTQTTPLKTSWVNCSNMIDEIITHLKQPPLPLLDFNNLNGEDQDILMENNLRRPNLEAFNQAVKSLQNASAIESILKNLLPCLPLATAAPTRHPIHIKDGDWNEFRRKLTFYLKTLENAQAQQTTLSLAIF

SEQ ID NO: 489 - protein, 133 aa, Homo sapiens
APMTQTTPLKTSWVNCSNMIDEIITHLKQPPLPLLDFNNLNGEDQDILMENNLRRPNLEAFNRAVQSLQNASAIESILKNLLPCLPLATAAPTRHPIHIKDGDWNEFRRKLTFYLKTLENAQAQQTTLSLAIF

SEQ ID NO: 490 - protein, 133 aa, Homo sapiens
APMTQTTPLKTSWVNCSNMIDEIITHLKQPPLPLLDFNNLNGEDQDILMENNLRRPNLEAFNRAVNSLQNASAIESILKNLLPCLPLATAAPTRHPIHIKDGDWNEFRRKLTFYLKTLENAQAQQTTLSLAIF

SEQ ID NO: 491 - protein, 133 aa, Homo sapiens
APMTQTTPLKTSWVNCSNMIDEIITHLKQPPLPLLDFNNLNGEDQDILMENNLRRPNLEAFNRAVKSLQNASAIESILKNLLPCLPLATAAPTRHSIHIKDGDWNEFRRKLTFYLKTLENAQAQQTTLSLAIF

SEQ ID NO: 492 - protein, 133 aa, Homo sapiens
APMTQTTPLKTSWVNCSNMIDEIITHLKQPPLPLLDFNNLNGEDQDILMENNLRRPNLEAFNRAVKSLQNASAIESILKNLLPCLPLATAAPTRHAIHIKDGDWNEFRRKLTFYLKTLENAQAQQTTLSLAIF

SEQ ID NO: 493 - protein, 133 aa, Homo sapiens
APMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIQDGDWNEFRRKLTFYLKTLENAQAQQTTLSLAIF

SEQ ID NO: 494 - protein, 133 aa, Homo sapiens
APMTQTTPLKTSWVNCSNMIDEIITHLKQPPLPLLDFNNLNGEDQDILMENNLRRPNLEAFNRAVKSLQNASAIESILKNLLPCLPLATAAPTRHPIHINDGDWNEFRRKLTFYLKTLENAQAQQTTLSLAIF

SEQ ID NO: 495 - protein, 133 aa, Homo sapiens
APMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKQGDWNEFRRKLTFYLKTLENAQAQQTTLSLAIF

SEQ ID NO: 496 - protein, 133 aa, Homo sapiens
APMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKNGDWNEFRRKLTFYLKTLENAQAQQTTLSLAIF

SEQ ID NO: 497 - protein, 133 aa, Homo sapiens
APMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGQWNEFRRKLTFYLKTLENAQAQQTTLSLAIF

SEQ ID NO: 498 - protein, 133 aa, Homo sapiens
APMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGNWNEFRRKLTFYLKTLENAQAQQTTLSLAIF

SEQ ID NO: 499 - protein, 248 aa, Homo sapiens
EGICRNRVTNNVKDVTKLVANLPKDYVITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 500 - protein, 248 aa, Homo sapiens
EGICRNRVTNNVKDVTKLVANLPKDYIITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 501 - protein, 248 aa, Homo sapiens
EGICRNRVTNNVKDVTKLVANLPKDYMITLQYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 502 - protein, 248 aa, Homo sapiens
EGICRNRVTNNVKDVTKLVANLPKDYMITLNYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 503 - protein, 248 aa, Homo sapiens
EGICRNRVTNNVKDVTKLVANLPKDYMITLKYVSGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 504 - protein, 248 aa, Homo sapiens
EGICRNRVTNNVKDVTKLVANLPKDYMITLKYVAGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 505 - protein, 248 aa, Homo sapiens
EGICRNRVTNNVKDVTKLVANLPKDYMITLKYVPGMQVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 506 - protein, 248 aa, Homo sapiens
EGICRNRVTNNVKDVTKLVANLPKDYMITLKYVPGMNVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 507 - protein, 248 aa, Homo sapiens
EGICRNRVTNNVKDVTKLVANLPKDYMITLKYVPGMDVLPSHCWISEMVVQLSQSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 508 - protein, 248 aa, Homo sapiens
EGICRNRVTNNVKDVTKLVANLPKDYMITLKYVPGMDVLPSHCWISEMVVQLSNSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 509 - protein, 248 aa, Homo sapiens
EGICRNRVTNNVKDVTKLVANLPKDYMITLKYVPGMDVLPSHCWISEMVVQLSDSLTQLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 510 - protein, 248 aa, Homo sapiens
EGICRNRVTNNVKDVTKLVANLPKDYMITLKYVPGMDVLPSHCWISEMVVQLSDSLTNLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 511 - protein, 248 aa, Homo sapiens
EGICRNRVTNNVKDVTKLVANLPKDYMITLKYVPGMDVLPSHCWISEMVVQLSDSLTDLLQKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 512 - protein, 248 aa, Homo sapiens
EGICRNRVTNNVKDVTKLVANLPKDYMITLKYVPGMDVLPSHCWISEMVVQLSDSLTDLLNKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 513 - protein, 248 aa, Homo sapiens
EGICRNRVTNNVKDVTKLVANLPKDYMITLKYVPGMDVLPSHCWISEMVVQLSDSLTDLLDQFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 514 - protein, 248 aa, Homo sapiens
EGICRNRVTNNVKDVTKLVANLPKDYMITLKYVPGMDVLPSHCWISEMVVQLSDSLTDLLDNFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 515 - protein, 248 aa, Homo sapiens
EGICRNRVTNNVKDVTKLVANLPKDYMITLKYVPGMDVLPSHCWISEMVVQLSDSLTDLLDKISNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 516 - protein, 248 aa, Homo sapiens
EGICRNRVTNNVKDVTKLVANLPKDYMITLKYVPGMDVLPSHCWISEMVVQLSDSLTDLLDKVSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 517 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSQDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 518 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSNDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 519 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDVKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 520 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDIKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 521 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLQKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 522 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLNKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 523 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKQSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 524 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKNSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 525 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSIKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 526 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSVKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 527 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFQSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 528 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFNSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 529 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPQPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 530 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPNPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 531 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPHPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 532 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPESRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 533 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEARLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 534 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPHLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 535 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPQLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 536 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRVFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 537 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRIFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 538 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASQTSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 539 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASNTSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 540 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASHTSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 541 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSQCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 542 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSNCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 543 - protein, 129 aa, Homo sapiens
HKCDITLQEIIKTLNSLTEQKTLCTQLTVTDIFAASKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 544 - protein, 129 aa, Homo sapiens
HKCDITLQEIIKTLNSLTEQKTLCTNLTVTDIFAASKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 545 - protein, 129 aa, Homo sapiens
HKCDITLQEIIKTLNSLTEQKTLCTHLTVTDIFAASKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 546 - protein, 129 aa, Homo sapiens
HKCDITLQEIIKTLNSLTEQKTLCTELTVTDIFAASQNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 547 - protein, 129 aa, Homo sapiens
HKCDITLQEIIKTLNSLTEQKTLCTELTVTDIFAASNNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 548 - protein, 129 aa, Homo sapiens
HKCDITLQEIIKTLNSLTEQKTLCTELTVTDIFAASKNTTEKETFCRAATVLHQFYSHHEKDTRCLGATAQQFHRHKQLIRFLKRLDRNLWGLAGLNSCPVKEANQSTLENFLERLKTIMREKYSKCSS

SEQ ID NO: 549 - protein, 129 aa, Homo sapiens
HKCDITLQEIIKTLNSLTEQKTLCTELTVTDIFAASKNTTEKETFCRAATVLQQFYSHHEKDTRCLGATAQQFHRHKQLIRFLKRLDRNLWGLAGLNSCPVKEANQSTLENFLERLKTIMREKYSKCSS

SEQ ID NO: 550 - protein, 129 aa, Homo sapiens
HKCDITLQEIIKTLNSLTEQKTLCTELTVTDIFAASKNTTEKETFCRAATVLRQFYSHHQKDTRCLGATAQQFHRHKQLIRFLKRLDRNLWGLAGLNSCPVKEANQSTLENFLERLKTIMREKYSKCSS

SEQ ID NO: 551 - protein, 129 aa, Homo sapiens
HKCDITLQEIIKTLNSLTEQKTLCTELTVTDIFAASKNTTEKETFCRAATVLRQFYSHHNKDTRCLGATAQQFHRHKQLIRFLKRLDRNLWGLAGLNSCPVKEANQSTLENFLERLKTIMREKYSKCSS

SEQ ID NO: 552 - protein, 129 aa, Homo sapiens
HKCDITLQEIIKTLNSLTEQKTLCTELTVTDIFAASKNTTEKETFCRAATVLRQFYSHHHKDTRCLGATAQQFHRHKQLIRFLKRLDRNLWGLAGLNSCPVKEANQSTLENFLERLKTIMREKYSKCSS

SEQ ID NO: 553 - protein, 129 aa, Homo sapiens
HKCDITLQEIIKTLNSLTEQKTLCTELTVTDIFAASKNTTEKETFCRAATVLRQFYSHHEQDTRCLGATAQQFHRHKQLIRFLKRLDRNLWGLAGLNSCPVKEANQSTLENFLERLKTIMREKYSKCSS

SEQ ID NO: 554 - protein, 129 aa, Homo sapiens
HKCDITLQEIIKTLNSLTEQKTLCTELTVTDIFAASKNTTEKETFCRAATVLRQFYSHHENDTRCLGATAQQFHRHKQLIRFLKRLDRNLWGLAGLNSCPVKEANQSTLENFLERLKTIMREKYSKCSS

SEQ ID NO: 555 - protein, 129 aa, Homo sapiens
HKCDITLQEIIKTLNSLTEQKTLCTELTVTDIFAASKNTTEKETFCRAATVLRQFYSHHEKDTHCLGATAQQFHRHKQLIRFLKRLDRNLWGLAGLNSCPVKEANQSTLENFLERLKTIMREKYSKCSS

SEQ ID NO: 556 - protein, 129 aa, Homo sapiens
HKCDITLQEIIKTLNSLTEQKTLCTELTVTDIFAASKNTTEKETFCRAATVLRQFYSHHEKDTQCLGATAQQFHRHKQLIRFLKRLDRNLWGLAGLNSCPVKEANQSTLENFLERLKTIMREKYSKCSS

SEQ ID NO: 557 - protein, 129 aa, Homo sapiens
HKCDITLQEIIKTLNSLTEQKTLCTELTVTDIFAASKNTTEKETFCRAATVLRQFYSHHEKDTRCVGATAQQFHRHKQLIRFLKRLDRNLWGLAGLNSCPVKEANQSTLENFLERLKTIMREKYSKCSS

SEQ ID NO: 558 - protein, 129 aa, Homo sapiens
HKCDITLQEIIKTLNSLTEQKTLCTELTVTDIFAASKNTTEKETFCRAATVLRQFYSHHEKDTRCIGATAQQFHRHKQLIRFLKRLDRNLWGLAGLNSCPVKEANQSTLENFLERLKTIMREKYSKCSS

SEQ ID NO: 559 - protein, 129 aa, Homo sapiens
HKCDITLQEIIKTLNSLTEQKTLCTELTVTDIFAASKNTTEKETFCRAATVLRQFYSHHEKDTRCLGATAQQFHRHKQLIRFLKRLDRNLWGLAGLNSCSVKEANQSTLENFLERLKTIMREKYSKCSS

SEQ ID NO: 560 - protein, 129 aa, Homo sapiens
HKCDITLQEIIKTLNSLTEQKTLCTELTVTDIFAASKNTTEKETFCRAATVLRQFYSHHEKDTRCLGATAQQFHRHKQLIRFLKRLDRNLWGLAGLNSCAVKEANQSTLENFLERLKTIMREKYSKCSS

SEQ ID NO: 561 - protein, 129 aa, Homo sapiens
HKCDITLQEIIKTLNSLTEQKTLCTELTVTDIFAASKNTTEKETFCRAATVLRQFYSHHEKDTRCLGATAQQFHRHKQLIRFLKRLDRNLWGLAGLNSCPVQEANQSTLENFLERLKTIMREKYSKCSS

SEQ ID NO: 562 - protein, 129 aa, Homo sapiens
HKCDITLQEIIKTLNSLTEQKTLCTELTVTDIFAASKNTTEKETFCRAATVLRQFYSHHEKDTRCLGATAQQFHRHKQLIRFLKRLDRNLWGLAGLNSCPVNEANQSTLENFLERLKTIMREKYSKCSS

SEQ ID NO: 563 - protein, 129 aa, Homo sapiens
HKCDITLQEIIKTLNSLTEQKTLCTELTVTDIFAASKNTTEKETFCRAATVLRQFYSHHEKDTRCLGATAQQFHRHKQLIRFLKRLDRNLWGLAGLNSCPVKQANQSTLENFLERLKTIMREKYSKCSS

SEQ ID NO: 564 - protein, 129 aa, Homo sapiens
HKCDITLQEIIKTLNSLTEQKTLCTELTVTDIFAASKNTTEKETFCRAATVLRQFYSHHEKDTRCLGATAQQFHRHKQLIRFLKRLDRNLWGLAGLNSCPVKNANQSTLENFLERLKTIMREKYSKCSS

SEQ ID NO: 565 - protein, 129 aa, Homo sapiens
HKCDITLQEIIKTLNSLTEQKTLCTELTVTDIFAASKNTTEKETFCRAATVLRQFYSHHEKDTRCLGATAQQFHRHKQLIRFLKRLDRNLWGLAGLNSCPVKHANQSTLENFLERLKTIMREKYSKCSS

SEQ ID NO: 566 - protein, 129 aa, Homo sapiens
HKCDITLQEIIKTLNSLTEQKTLCTELTVTDIFAASKNTTEKETFCRAATVLRQFYSHHEKDTRCLGATAQQFHRHKQLIRFLKRLDRNLWGLAGLNSCPVKEANQSTLENFLERLKTIMREKYSQCSS

SEQ ID NO: 567 - protein, 129 aa, Homo sapiens
HKCDITLQEIIKTLNSLTEQKTLCTELTVTDIFAASKNTTEKETFCRAATVLRQFYSHHEKDTRCLGATAQQFHRHKQLIRFLKRLDRNLWGLAGLNSCPVKEANQSTLENFLERLKTIMREKYSNCSS

SEQ ID NO: 568 - protein, 115 aa, Homo sapiens
IPTEIPTSALVKETLALLSTHRTLLIANETLHIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 569 - protein, 115 aa, Homo sapiens
IPTEIPTSALVKETLALLSTHRTLLIANETLQIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 570 - protein, 115 aa, Homo sapiens
IPTEIPTSALVKETLALLSTHRTLLIANETLRISVPVHKNHQLCTEEIFQGIGTLESQTVQGGTVERLFKNLSLIKKYIDGQKKKCGEERRRVNQFLDYLQEFLGVMNTEWIIES

SEQ ID NO: 571 - protein, 115 aa, Homo sapiens
IPTEIPTSALVKETLALLSTHRTLLIANETLRIAVPVHKNHQLCTEEIFQGIGTLESQTVQGGTVERLFKNLSLIKKYIDGQKKKCGEERRRVNQFLDYLQEFLGVMNTEWIIES

SEQ ID NO: 572 - protein, 115 aa, Homo sapiens
IPTEIPTSALVKETLALLSTHRTLLIANETLRIPVPVHQNHQLCTEEIFQGIGTLESQTVQGGTVERLFKNLSLIKKYIDGQKKKCGEERRRVNQFLDYLQEFLGVMNTEWIIES

SEQ ID NO: 573 - protein, 115 aa, Homo sapiens
IPTEIPTSALVKETLALLSTHRTLLIANETLRIPVPVHNNHQLCTEEIFQGIGTLESQTVQGGTVERLFKNLSLIKKYIDGQKKKCGEERRRVNQFLDYLQEFLGVMNTEWIIES

SEQ ID NO: 574 - protein, 115 aa, Homo sapiens
IPTEIPTSALVKETLALLSTHRTLLIANETLRIPVPVHKNHQLCTQEIFQGIGTLESQTVQGGTVERLFKNLSLIKKYIDGQKKKCGEERRRVNQFLDYLQEFLGVMNTEWIIES

SEQ ID NO: 575 - protein, 115 aa, Homo sapiens
IPTEIPTSALVKETLALLSTHRTLLIANETLRIPVPVHKNHQLCTNEIFQGIGTLESQTVQGGTVERLFKNLSLIKKYIDGQKKKCGEERRRVNQFLDYLQEFLGVMNTEWIIES

SEQ ID NO: 576 - protein, 115 aa, Homo sapiens
IPTEIPTSALVKETLALLSTHRTLLIANETLRIPVPVHKNHQLCTHEIFQGIGTLESQTVQGGTVERLFKNLSLIKKYIDGQKKKCGEERRRVNQFLDYLQEFLGVMNTEWIIES

SEQ ID NO: 577 - protein, 115 aa, Homo sapiens
IPTEIPTSALVKETLALLSTHRTLLIANETLRIPVPVHKNHQLCTEQIFQGIGTLESQTVQGGTVERLFKNLSLIKKYIDGQKKKCGEERRRVNQFLDYLQEFLGVMNTEWIIES

SEQ ID NO: 578 - protein, 115 aa, Homo sapiens
IPTEIPTSALVKETLALLSTHRTLLIANETLRIPVPVHKNHQLCTENIFQGIGTLESQTVQGGTVERLFKNLSLIKKYIDGQKKKCGEERRRVNQFLDYLQEFLGVMNTEWIIES

SEQ ID NO: 579 - protein, 115 aa, Homo sapiens
IPTEIPTSALVKETLALLSTHRTLLIANETLRIPVPVHKNHQLCTEHIFQGIGTLESQTVQGGTVERLFKNLSLIKKYIDGQKKKCGEERRRVNQFLDYLQEFLGVMNTEWIIES

SEQ ID NO: 580 - protein, 115 aa, Homo sapiens
IPTEIPTSALVKETLALLSTHRTLLIANETLRIPVPVHKNHQLCTEEIFQGIGTLQSQTVQGGTVERLFKNLSLIKKYIDGQKKKCGEERRRVNQFLDYLQEFLGVMNTEWIIES

SEQ ID NO: 581 - protein, 115 aa, Homo sapiens
IPTEIPTSALVKETLALLSTHRTLLIANETLRIPVPVHKNHQLCTEEIFQGIGTLNSQTVQGGTVERLFKNLSLIKKYIDGQKKKCGEERRRVNQFLDYLQEFLGVMNTEWIIES

SEQ ID NO: 582 - protein, 115 aa, Homo sapiens
IPTEIPTSALVKETLALLSTHRTLLIANETLRIPVPVHKNHQLCTEEIFQGIGTLHSQTVQGGTVERLFKNLSLIKKYIDGQKKKCGEERRRVNQFLDYLQEFLGVMNTEWIIES

SEQ ID NO: 583 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKQKCGEERRRVNQFLDYLQEFLGVMNTEWIIES

SEQ ID NO: 584 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKNKCGEERRRVNQFLDYLQEFLGVMNTEWIIES

SEQ ID NO: 585 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKQCGEERRRVNQFLDYLQEFLGVMNTEWIIES

SEQ ID NO: 586 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKNCGEERRRVNQFLDYLQEFLGVMNTEWIIES

SEQ ID NO: 587 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGQERRRVNQFLDYLQEFLGVMNTEWIIES

SEQ ID NO: 588 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGNERRRVNQFLDYLQEFLGVMNTEWIIES

SEQ ID NO: 589 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGHERRRVNQFLDYLQEFLGVMNTEWIIES

SEQ ID NO: 590 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEQRRRVNQFLDYLQEFLGVMNTEWIIES

SEQ ID NO: 591 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGENRRRVNQFLDYLQEFLGVMNTEWIIES

SEQ ID NO: 592 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEHRRRVNQFLDYLQEFLGVMNTEWIIES

SEQ ID NO: 593 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEEHRRVNQFLDYLQEFLGVMNTEWIIES

SEQ ID NO: 594 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEEQRRVNQFLDYLQEFLGVMNTEWIIES

SEQ ID NO: 595 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQQFLGVMNTEWIIES

SEQ ID NO: 596 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQNFLGVMNTEWIIES

SEQ ID NO: 597 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQHFLGVMNTEWIIES

SEQ ID NO: 598 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTQWIIES

SEQ ID NO: 599 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTNWIIES

SEQ ID NO: 600 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTHWIIES

SEQ ID NO: 601 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTESIIES

SEQ ID NO: 602 - protein, 115 aa, Homo sapiens
IPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEHIIES

SEQ ID NO: 603 - protein, 112 aa, homo sapiens
GPVPPSTALRELIEELVNITQNQKAPLCNGSVVWSINLTAGMYCAALESLINVSGCSAIEKTQRMLSGFCPHKVSAGQFSSLHVRDTKIEVAQFVKDLLLHLKKLFREGRFN

SEQ ID NO: 604 - protein, 112 aa, homo sapiens
GPVPPSTALRELIEELVNITQNQKAPLCNGSIVWSINLTAGMYCAALESLINVSGCSAIEKTQRMLSGFCPHKVSAGQFSSLHVRDTKIEVAQFVKDLLLHLKKLFREGRFN

SEQ ID NO: 605 - protein, 112 aa, homo sapiens
GPVPPSTALRELIEELVNITQNQKAPLCNGSMVSSINLTAGMYCAALESLINVSGCSAIEKTQRMLSGFCPHKVSAGQFSSLHVRDTKIEVAQFVKDLLLHLKKLFREGRFN

SEQ ID NO: 606 - protein, 112 aa, homo sapiens
GPVPPSTALRELIEELVNITQNQKAPLCNGSMVHSINLTAGMYCAALESLINVSGCSAIEKTQRMLSGFCPHKVSAGQFSSLHVRDTKIEVAQFVKDLLLHLKKLFREGRFN

SEQ ID NO: 607 - protein, 112 aa, homo sapiens
GPVPPSTALRELIEELVNITQNQKAPLCNGSMVWSINVTAGMYCAALESLINVSGCSAIEKTQRMLSGFCPHKVSAGQFSSLHVRDTKIEVAQFVKDLLLHLKKLFREGRFN

SEQ ID NO: 608 - protein, 112 aa, homo sapiens
GPVPPSTALRELIEELVNITQNQKAPLCNGSMVWSINITAGMYCAALESLINVSGCSAIEKTQRMLSGFCPHKVSAGQFSSLHVRDTKIEVAQFVKDLLLHLKKLFREGRFN

SEQ ID NO: 609 - protein, 112 aa, homo sapiens
GPVPPSTALRELIEELVNITQNQKAPLCNGSMVWSINLTAGMYCAALQSLINVSGCSAIEKTQRMLSGFCPHKVSAGQFSSLHVRDTKIEVAQFVKDLLLHLKKLFREGRFN

SEQ ID NO: 610 - protein, 112 aa, homo sapiens
GPVPPSTALRELIEELVNITQNQKAPLCNGSMVWSINLTAGMYCAALNSLINVSGCSAIEKTQRMLSGFCPHKVSAGQFSSLHVRDTKIEVAQFVKDLLLHLKKLFREGRFN

SEQ ID NO: 611 - protein, 112 aa, homo sapiens
GPVPPSTALRELIEELVNITQNQKAPLCNGSMVWSINLTAGMYCAALHSLINVSGCSAIEKTQRMLSGFCPHKVSAGQFSSLHVRDTKIEVAQFVKDLLLHLKKLFREGRFN

SEQ ID NO: 612 - protein, 112 aa, homo sapiens
GPVPPSTALRELIEELVNITQNQKAPLCNGSMVWSINLTAGMYCAALESLINVSGCSAIEKTQRMLSGFCPHKVSAGQISSLHVRDTKIEVAQFVKDLLLHLKKLFREGRFN

SEQ ID NO: 613 - protein, 112 aa, homo sapiens
GPVPPSTALRELIEELVNITQNQKAPLCNGSMVWSINLTAGMYCAALESLINVSGCSAIEKTQRMLSGFCPHKVSAGQVSSLHVRDTKIEVAQFVKDLLLHLKKLFREGRFN

SEQ ID NO: 614 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSVHVRDTKIEVAQFVKDLLLHLKKLFREGRFN

SEQ ID NO: 615 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSIHVRDTKIEVAQFVKDLLLHLKKLFREGRFN

SEQ ID NO: 616 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVHDTKIEVAQFVKDLLLHLKKLFREGRFN

SEQ ID NO: 617 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVQDTKIEVAQFVKDLLLHLKKLFREGRFN

SEQ ID NO: 618 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRQTKIEVAQFVKDLLLHLKKLFREGRFN

SEQ ID NO: 619 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRNTKIEVAQFVKDLLLHLKKLFREGRFN

SEQ ID NO: 620 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTQIEVAQFVKDLLLHLKKLFREGRFN

SEQ ID NO: 621 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTNIEVAQFVKDLLLHLKKLFREGRFN

SEQ ID NO: 622 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFHEGRFN

SEQ ID NO: 623 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFQEGRFN

SEQ ID NO: 624 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFRQGRFN

SEQ ID NO: 625 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFRNGRFN

SEQ ID NO: 626 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFRHGRFN

SEQ ID NO: 627 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGHFN

SEQ ID NO: 628 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFN

SEQ ID NO: 629 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRIN

SEQ ID NO: 630 - protein, 112 aa, homo sapiens
GPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRVN

SEQ ID NO: 631 - protein, 177 aa, homo sapiens
TPLGPASSLPQSFLLKCLEQVRKIQGDGAALQEKLVSECATYKLCHPEELVLLGHSLGIPSAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 632 - protein, 177 aa, homo sapiens
TPLGPASSLPQSFLLKCLEQVRKIQGDGAALQEKLVSECATYKLCHPEELVLLGHSLGIPHAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 633 - protein, 177 aa, homo sapiens
TPLGPASSLPQSFLLKCLEQVRKIQGDGAALQEKLVSECATYKLCHPEELVLLGHSLGIPWASLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 634 - protein, 177 aa, homo sapiens
TPLGPASSLPQSFLLKCLEQVRKIQGDGAALQEKLVSECATYKLCHPEELVLLGHSLGIPWAALSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 635 - protein, 177 aa, homo sapiens
TPLGPASSLPQSFLLKCLEQVRKIQGDGAALQEKLVSECATYKLCHPEELVLLGHSLGIPWAPLSSCSSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 636 - protein, 177 aa, homo sapiens
TPLGPASSLPQSFLLKCLEQVRKIQGDGAALQEKLVSECATYKLCHPEELVLLGHSLGIPWAPLSSCASQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 637 - protein, 177 aa, homo sapiens
TPLGPASSLPQSFLLKCLEQVRKIQGDGAALQEKLVSECATYKLCHPEELVLLGHSLGIPWAPLSSCPSQAVQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 638 - protein, 177 aa, homo sapiens
TPLGPASSLPQSFLLKCLEQVRKIQGDGAALQEKLVSECATYKLCHPEELVLLGHSLGIPWAPLSSCPSQAIQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 639 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLILYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 640 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLVLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 641 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALQGISPELGPTLDTLQLDVADFATTIWQQMEELGMAPALQPTQGAMPAFASAFQRRAGGVLVASHLQSFLEVSYRVLRHLAQP

SEQ ID NO: 642 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALNGISPELGPTLDTLQLDVADFATTIWQQMEELGMAPALQPTQGAMPAFASAFQRRAGGVLVASHLQSFLEVSYRVLRHLAQP

SEQ ID NO: 643 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALHGISPELGPTLDTLQLDVADFATTIWQQMEELGMAPALQPTQGAMPAFASAFQRRAGGVLVASHLQSFLEVSYRVLRHLAQP

SEQ ID NO: 644 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISSELGPTLDTLQLDVADFATTIWQQMEELGMAPALQPTQGAMPAFASAFQRRAGGVLVASHLQSFLEVSYRVLRHLAQP

SEQ ID NO: 645 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISAELGPTLDTLQLDVADFATTIWQQMEELGMAPALQPTQGAMPAFASAFQRRAGGVLVASHLQSFLEVSYRVLRHLAQP

SEQ ID NO: 646 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPQLGPTLDTLQLDVADFATTIWQQMEELGMAPALQPTQGAMPAFASAFQRRAGGVLVASHLQSFLEVSYRVLRHLAQP

SEQ ID NO: 647 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPNLGPTLDTLQLDVADFATTIWQQMEELGMAPALQPTQGAMPAFASAFQRRAGGVLVASHLQSFLEVSYRVLRHLAQP

SEQ ID NO: 648 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPHLGPTLDTLQLDVADFATTIWQQMEELGMAPALQPTQGAMPAFASAFQRRAGGVLVASHLQSFLEVSYRVLRHLAQP

SEQ ID NO: 649 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMASALQPTQGAMPAFASAFQRRAGGVLVASHLQSFLEVSYRVLRHLAQP

SEQ ID NO: 650 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAAALQPTQGAMPAFASAFQRRAGGVLVASHLQSFLEVSYRVLRHLAQP

SEQ ID NO: 651 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPAVQPTQGAMPAFASAFQRRAGGVLVASHLQSFLEVSYRVLRHLAQP

SEQ ID NO: 652 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPAIQPTQGAMPAFASAFQRRAGGVLVASHLQSFLEVSYRVLRHLAQP

SEQ ID NO: 653 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQSTQGAMPAFASAFQRRAGGVLVASHLQSFLEVSYRVLRHLAQP

SEQ ID NO: 654 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQATQGAMPAFASAFQRRAGGVLVASHLQSFLEVSYRVLRHLAQP

SEQ ID NO: 655 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAIQRRAGGVLVASHLQSFLEVSYRVLRHLAQP

SEQ ID NO: 656 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAVQRRAGGVLVASHLQSFLEVSYRVLRHLAQP

SEQ ID NO: 657 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYHVLRHLAQP

SEQ ID NO: 658 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYQVLRHLAQP

SEQ ID NO: 659 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLHHLAQP

SEQ ID NO: 660 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLQHLAQP

SEQ ID NO: 661 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQS

SEQ ID NO: 662 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQA

SEQ ID NO: 663 - protein, 146 aa, Homo sapiens
VPIQKVQDDTKTLIKTIVTRINDISHTQSVSSKQKVTGLDFISGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 664 - protein, 146 aa, Homo sapiens
VPIQKVQDDTKTLIKTIVTRINDISHTQSVSSKQKVTGLDFIAGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 665 - protein, 146 aa, Homo sapiens
VPIQKVQDDTKTLIKTIVTRINDISHTQSVSSKQKVTGLDFIPGLHPIVTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 666 - protein, 146 aa, Homo sapiens
VPIQKVQDDTKTLIKTIVTRINDISHTQSVSSKQKVTGLDFIPGLHPIITLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 667 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLSWASGLETLDSLGGVLEASGYSTEVVALSRLQGSLQDMLWQLDLSPGC

SEQ ID NO: 668 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLAWASGLETLDSLGGVLEASGYSTEVVALSRLQGSLQDMLWQLDLSPGC

SEQ ID NO: 669 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPSASGLETLDSLGGVLEASGYSTEVVALSRLQGSLQDMLWQLDLSPGC

SEQ ID NO: 670 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPHASGLETLDSLGGVLEASGYSTEVVALSRLQGSLQDMLWQLDLSPGC

SEQ ID NO: 671 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGVETLDSLGGVLEASGYSTEVVALSRLQGSLQDMLWQLDLSPGC

SEQ ID NO: 672 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGIETLDSLGGVLEASGYSTEVVALSRLQGSLQDMLWQLDLSPGC

SEQ ID NO: 673 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLQTLDSLGGVLEASGYSTEVVALSRLQGSLQDMLWQLDLSPGC

SEQ ID NO: 674 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLNTLDSLGGVLEASGYSTEVVALSRLQGSLQDMLWQLDLSPGC

SEQ ID NO: 675 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLHTLDSLGGVLEASGYSTEVVALSRLQGSLQDMLWQLDLSPGC

SEQ ID NO: 676 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETVDSLGGVLEASGYSTEVVALSRLQGSLQDMLWQLDLSPGC

SEQ ID NO: 677 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETIDSLGGVLEASGYSTEVVALSRLQGSLQDMLWQLDLSPGC

SEQ ID NO: 678 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLQSLGGVLEASGYSTEVVALSRLQGSLQDMLWQLDLSPGC

SEQ ID NO: 679 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLNSLGGVLEASGYSTEVVALSRLQGSLQDMLWQLDLSPGC

SEQ ID NO: 680 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLQLSPGC

SEQ ID NO: 681 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLNLSPGC

SEQ ID NO: 682 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDVSPGC

SEQ ID NO: 683 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDISPGC

SEQ ID NO: 684 - protein, 200 aa, Homo sapiens
MAFTEHSPLTPHRRDLCSRSIWLARKIRSDLTALTESYVKHQGLNKNINLDSADGMPVASTQQWSELTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 685 - protein, 200 aa, Homo sapiens
MAFTEHSPLTPHRRDLCSRSIWLARKIRSDLTALTESYVKHQGLNKNINLDSADGMPVASTNQWSELTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 686 - protein, 200 aa, Homo sapiens
MAFTEHSPLTPHRRDLCSRSIWLARKIRSDLTALTESYVKHQGLNKNINLDSADGMPVASTDQSSELTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 687 - protein, 200 aa, Homo sapiens
MAFTEHSPLTPHRRDLCSRSIWLARKIRSDLTALTESYVKHQGLNKNINLDSADGMPVASTDQHSELTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 688 - protein, 200 aa, Homo sapiens
MAFTEHSPLTPHRRDLCSRSIWLARKIRSDLTALTESYVKHQGLNKNINLDSADGMPVASTDQWSQLTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 689 - protein, 200 aa, Homo sapiens
MAFTEHSPLTPHRRDLCSRSIWLARKIRSDLTALTESYVKHQGLNKNINLDSADGMPVASTDQWSNLTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 690 - protein, 200 aa, Homo sapiens
MAFTEHSPLTPHRRDLCSRSIWLARKIRSDLTALTESYVKHQGLNKNINLDSADGMPVASTDQWSHLTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 691 - protein, 200 aa, Homo sapiens
MAFTEHSPLTPHRRDLCSRSIWLARKIRSDLTALTESYVKHQGLNKNINLDSADGMPVASTDQWSEVTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 692 - protein, 200 aa, Homo sapiens
MAFTEHSPLTPHRRDLCSRSIWLARKIRSDLTALTESYVKHQGLNKNINLDSADGMPVASTDQWSEITEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 693 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVVLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 694 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVILARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 695 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLAHLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 696 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLAQLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 697 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLQDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 698 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLNDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 699 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLHDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 700 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTSTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 701 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTATEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 702 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTQGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 703 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTNGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 704 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTHGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 705 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGQFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 706 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGNFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 707 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLQYKIPRNEADGMPINVGDGGLFEKKLWGLKVLQELSQWTVRSIHDLRFISSHQTGIPARGSHYIANNKKM

SEQ ID NO: 708 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLNYKIPRNEADGMPINVGDGGLFEKKLWGLKVLQELSQWTVRSIHDLRFISSHQTGIPARGSHYIANNKKM

SEQ ID NO: 709 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLHYKIPRNEADGMPINVGDGGLFEKKLWGLKVLQELSQWTVRSIHDLRFISSHQTGIPARGSHYIANNKKM

SEQ ID NO: 710 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEHKIPRNEADGMPINVGDGGLFEKKLWGLKVLQELSQWTVRSIHDLRFISSHQTGIPARGSHYIANNKKM

SEQ ID NO: 711 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEIKIPRNEADGMPINVGDGGLFEKKLWGLKVLQELSQWTVRSIHDLRFISSHQTGIPARGSHYIANNKKM

SEQ ID NO: 712 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYQIPRNEADGMPINVGDGGLFEKKLWGLKVLQELSQWTVRSIHDLRFISSHQTGIPARGSHYIANNKKM

SEQ ID NO: 713 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYNIPRNEADGMPINVGDGGLFEKKLWGLKVLQELSQWTVRSIHDLRFISSHQTGIPARGSHYIANNKKM

SEQ ID NO: 714 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKISRNEADGMPINVGDGGLFEKKLWGLKVLQELSQWTVRSIHDLRFISSHQTGIPARGSHYIANNKKM

SEQ ID NO: 715 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIARNEADGMPINVGDGGLFEKKLWGLKVLQELSQWTVRSIHDLRFISSHQTGIPARGSHYIANNKKM

SEQ ID NO: 716 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPHNEADGMPINVGDGGLFEKKLWGLKVLQELSQWTVRSIHDLRFISSHQTGIPARGSHYIANNKKM

SEQ ID NO: 717 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPQNEADGMPINVGDGGLFEKKLWGLKVLQELSQWTVRSIHDLRFISSHQTGIPARGSHYIANNKKM

SEQ ID NO: 718 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNQADGMPINVGDGGLFEKKLWGLKVLQELSQWTVRSIHDLRFISSHQTGIPARGSHYIANNKKM

SEQ ID NO: 719 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNNADGMPINVGDGGLFEKKLWGLKVLQELSQWTVRSIHDLRFISSHQTGIPARGSHYIANNKKM

SEQ ID NO: 720 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNHADGMPINVGDGGLFEKKLWGLKVLQELSQWTVRSIHDLRFISSHQTGIPARGSHYIANNKKM

SEQ ID NO: 721 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEAQGMPINVGDGGLFEKKLWGLKVLQELSQWTVRSIHDLRFISSHQTGIPARGSHYIANNKKM

SEQ ID NO: 722 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEANGMPINVGDGGLFEKKLWGLKVLQELSQWTVRSIHDLRFISSHQTGIPARGSHYIANNKKM

SEQ ID NO: 723 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMSINVGDGGLFEKKLWGLKVLQELSQWTVRSIHDLRFISSHQTGIPARGSHYIANNKKM

SEQ ID NO: 724 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMAINVGDGGLFEKKLWGLKVLQELSQWTVRSIHDLRFISSHQTGIPARGSHYIANNKKM

SEQ ID NO: 725 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMPINVGQGGLFEKKLWGLKVLQELSQWTVRSIHDLRFISSHQTGIPARGSHYIANNKKM

SEQ ID NO: 726 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMPINVGNGGLFEKKLWGLKVLQELSQWTVRSIHDLRFISSHQTGIPARGSHYIANNKKM

SEQ ID NO: 727 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMPINVGDGGVFEKKLWGLKVLQELSQWTVRSIHDLRFISSHQTGIPARGSHYIANNKKM

SEQ ID NO: 728 - protein, 200 aa, Homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMPINVGDGGIFEKKLWGLKVLQELSQWTVRSIHDLRFISSHQTGIPARGSHYIANNKKM

SEQ ID NO: 729 - protein, 180 aa, Homo sapiens
SPLPITPVNATCAIRHPCHNNLMNQIRSQLAQLNGSANALFILYYTAQGEPFPNNLDKLCGPNVTDFPSFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 730 - protein, 180 aa, Homo sapiens
SPLPITPVNATCAIRHPCHNNLMNQIRSQLAQLNGSANALFILYYTAQGEPFPNNLDKLCGPNVTDFPAFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 731 - protein, 180 aa, Homo sapiens
SPLPITPVNATCAIRHPCHNNLMNQIRSQLAQLNGSANALFILYYTAQGEPFPNNLDKLCGPNVTDFPPIHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 732 - protein, 180 aa, Homo sapiens
SPLPITPVNATCAIRHPCHNNLMNQIRSQLAQLNGSANALFILYYTAQGEPFPNNLDKLCGPNVTDFPPVHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 733 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYHIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 734 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYQIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 735 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITHDQKILNPSALSLHSKLNATADILRGLLSNVLCRLCSKYHVGHVDVTYGPDTSGKDVFQKKKLGCQLLGKYKQIIAVLAQAF

SEQ ID NO: 736 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITQDQKILNPSALSLHSKLNATADILRGLLSNVLCRLCSKYHVGHVDVTYGPDTSGKDVFQKKKLGCQLLGKYKQIIAVLAQAF

SEQ ID NO: 737 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQQILNPSALSLHSKLNATADILRGLLSNVLCRLCSKYHVGHVDVTYGPDTSGKDVFQKKKLGCQLLGKYKQIIAVLAQAF

SEQ ID NO: 738 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQNILNPSALSLHSKLNATADILRGLLSNVLCRLCSKYHVGHVDVTYGPDTSGKDVFQKKKLGCQLLGKYKQIIAVLAQAF

SEQ ID NO: 739 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKIVNPSALSLHSKLNATADILRGLLSNVLCRLCSKYHVGHVDVTYGPDTSGKDVFQKKKLGCQLLGKYKQIIAVLAQAF

SEQ ID NO: 740 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKIINPSALSLHSKLNATADILRGLLSNVLCRLCSKYHVGHVDVTYGPDTSGKDVFQKKKLGCQLLGKYKQIIAVLAQAF

SEQ ID NO: 741 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNSSALSLHSKLNATADILRGLLSNVLCRLCSKYHVGHVDVTYGPDTSGKDVFQKKKLGCQLLGKYKQIIAVLAQAF

SEQ ID NO: 742 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNASALSLHSKLNATADILRGLLSNVLCRLCSKYHVGHVDVTYGPDTSGKDVFQKKKLGCQLLGKYKQIIAVLAQAF

SEQ ID NO: 743 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSAVSLHSKLNATADILRGLLSNVLCRLCSKYHVGHVDVTYGPDTSGKDVFQKKKLGCQLLGKYKQIIAVLAQAF

SEQ ID NO: 744 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSAISLHSKLNATADILRGLLSNVLCRLCSKYHVGHVDVTYGPDTSGKDVFQKKKLGCQLLGKYKQIIAVLAQAF

SEQ ID NO: 745 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKHHVGHVDVTYGPDTSGKDVFQKKKLGCQLLGKYKQIIAVLAQAF

SEQ ID NO: 746 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKIHVGHVDVTYGPDTSGKDVFQKKKLGCQLLGKYKQIIAVLAQAF

SEQ ID NO: 747 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVQVTYGPDTSGKDVFQKKKLGCQLLGKYKQIIAVLAQAF

SEQ ID NO: 748 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVNVTYGPDTSGKDVFQKKKLGCQLLGKYKQIIAVLAQAF

SEQ ID NO: 749 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTHGPDTSGKDVFQKKKLGCQLLGKYKQIIAVLAQAF

SEQ ID NO: 750 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTIGPDTSGKDVFQKKKLGCQLLGKYKQIIAVLAQAF

SEQ ID NO: 751 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGSDTSGKDVFQKKKLGCQLLGKYKQIIAVLAQAF

SEQ ID NO: 752 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGADTSGKDVFQKKKLGCQLLGKYKQIIAVLAQAF

SEQ ID NO: 753 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPQTSGKDVFQKKKLGCQLLGKYKQIIAVLAQAF

SEQ ID NO: 754 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPNTSGKDVFQKKKLGCQLLGKYKQIIAVLAQAF

SEQ ID NO: 755 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGQDVFQKKKLGCQLLGKYKQIIAVLAQAF

SEQ ID NO: 756 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGNDVFQKKKLGCQLLGKYKQIIAVLAQAF

SEQ ID NO: 757 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKQVFQKKKLGCQLLGKYKQIIAVLAQAF

SEQ ID NO: 758 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKNVFQKKKLGCQLLGKYKQIIAVLAQAF

SEQ ID NO: 759 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVIQKKKLGCQLLGKYKQIIAVLAQAF

SEQ ID NO: 760 - protein, 180 aa, Homo sapiens
SPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVVQKKKLGCQLLGKYKQIIAVLAQAF

SEQ ID NO: 761 - protein, 227 aa, Homo sapiens
AAIGSCSKEYRVLLGQLQKQTDLMQDTSRLLDPYIRIQGLDVPKLREHCRERPGAFPSQETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 762 - protein, 227 aa, Homo sapiens
AAIGSCSKEYRVLLGQLQKQTDLMQDTSRLLDPYIRIQGLDVPKLREHCRERPGAFPSNETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 763 - protein, 227 aa, Homo sapiens
AAIGSCSKEYRVLLGQLQKQTDLMQDTSRLLDPYIRIQGLDVPKLREHCRERPGAFPSHETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 764 - protein, 227 aa, Homo sapiens
AAIGSCSKEYRVLLGQLQKQTDLMQDTSRLLDPYIRIQGLDVPKLREHCRERPGAFPSEQTLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 765 - protein, 227 aa, Homo sapiens
AAIGSCSKEYRVLLGQLQKQTDLMQDTSRLLDPYIRIQGLDVPKLREHCRERPGAFPSENTLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 766 - protein, 227 aa, Homo sapiens
AAIGSCSKEYRVLLGQLQKQTDLMQDTSRLLDPYIRIQGLDVPKLREHCRERPGAFPSEHTLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 767 - protein, 227 aa, Homo sapiens
AAIGSCSKEYRVLLGQLQKQTDLMQDTSRLLDPYIRIQGLDVPKLREHCRERPGAFPSEETLHGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 768 - protein, 227 aa, Homo sapiens
AAIGSCSKEYRVLLGQLQKQTDLMQDTSRLLDPYIRIQGLDVPKLREHCRERPGAFPSEETLQGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 769 - protein, 227 aa, Homo sapiens
AAIGSCSKEYRVLLGQLQKQTDLMQDTSRLLDPYIRIQGLDVPKLREHCRERPGAFPSEETLRGVGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 770 - protein, 227 aa, Homo sapiens
AAIGSCSKEYRVLLGQLQKQTDLMQDTSRLLDPYIRIQGLDVPKLREHCRERPGAFPSEETLRGIGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 771 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHHLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 772 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHQLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 773 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLAQLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 774 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLANLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 775 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLQQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 776 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLNQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 777 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLHQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 778 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQHLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 779 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQQLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 780 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPQAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 781 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPNAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 782 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQQLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 783 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQNLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 784 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLQRSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 785 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLNRSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 786 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLHRSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 787 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLEHSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 788 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLEQSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 789 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGVNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 790 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGINIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 791 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIQDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 792 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNINDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 793 - protein, 227 aa, Homo sapiens
AAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIHDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 794 - protein, 197 aa, Homo sapiens
RNLPVATPDPGMFPCLHHSQNLLRAVSNMLQKARQTLEFYPCTSEEIDHEDITKDQTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 795 - protein, 197 aa, Homo sapiens
RNLPVATPDPGMFPCLHHSQNLLRAVSNMLQKARQTLEFYPCTSEEIDHEDITKDNTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 796 - protein, 197 aa, Homo sapiens
RNLPVATPDPGMFPCLHHSQNLLRAVSNMLQKARQTLEFYPCTSEEIDHEDITKDKTSTVQACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 797 - protein, 197 aa, Homo sapiens
RNLPVATPDPGMFPCLHHSQNLLRAVSNMLQKARQTLEFYPCTSEEIDHEDITKDKTSTVNACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 798 - protein, 197 aa, Homo sapiens
RNLPVATPDPGMFPCLHHSQNLLRAVSNMLQKARQTLEFYPCTSEEIDHEDITKDKTSTVHACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 799 - protein, 197 aa, Homo sapiens
RNLPVATPDPGMFPCLHHSQNLLRAVSNMLQKARQTLEFYPCTSEEIDHEDITKDKTSTVEACLPVELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 800 - protein, 197 aa, Homo sapiens
RNLPVATPDPGMFPCLHHSQNLLRAVSNMLQKARQTLEFYPCTSEEIDHEDITKDKTSTVEACLPIELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 801 - protein, 197 aa, Homo sapiens
RNLPVATPDPGMFPCLHHSQNLLRAVSNMLQKARQTLEFYPCTSEEIDHEDITKDKTSTVEACLPLQLTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 802 - protein, 197 aa, Homo sapiens
RNLPVATPDPGMFPCLHHSQNLLRAVSNMLQKARQTLEFYPCTSEEIDHEDITKDKTSTVEACLPLNLTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 803 - protein, 197 aa, Homo sapiens
RNLPVATPDPGMFPCLHHSQNLLRAVSNMLQKARQTLEFYPCTSEEIDHEDITKDKTSTVEACLPLHLTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 804 - protein, 197 aa, Homo sapiens
RNLPVATPDPGMFPCLHHSQNLLRAVSNMLQKARQTLEFYPCTSEEIDHEDITKDKTSTVEACLPLEVTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 805 - protein, 197 aa, Homo sapiens
RNLPVATPDPGMFPCLHHSQNLLRAVSNMLQKARQTLEFYPCTSEEIDHEDITKDKTSTVEACLPLEITKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 806 - protein, 197 aa, Homo sapiens
RNLPVATPDPGMFPCLHHSQNLLRAVSNMLQKARQTLEFYPCTSEEIDHEDITKDKTSTVEACLPLELTQNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 807 - protein, 197 aa, Homo sapiens
RNLPVATPDPGMFPCLHHSQNLLRAVSNMLQKARQTLEFYPCTSEEIDHEDITKDKTSTVEACLPLELTNNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 808 - protein, 197 aa, Homo sapiens
RNLPVATPDPGMFPCLHHSQNLLRAVSNMLQKARQTLEFYPCTSEEIDHEDITKDKTSTVEACLPLELTKNQSCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 809 - protein, 197 aa, Homo sapiens
RNLPVATPDPGMFPCLHHSQNLLRAVSNMLQKARQTLEFYPCTSEEIDHEDITKDKTSTVEACLPLELTKNNSCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 810 - protein, 197 aa, Homo sapiens
RNLPVATPDPGMFPCLHHSQNLLRAVSNMLQKARQTLEFYPCTSEEIDHEDITKDKTSTVEACLPLELTKNHSCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 811 - protein, 197 aa, Homo sapiens
RNLPVATPDPGMFPCLHHSQNLLRAVSNMLQKARQTLEFYPCTSEEIDHEDITKDKTSTVEACLPLELTKNESCVNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 812 - protein, 197 aa, Homo sapiens
RNLPVATPDPGMFPCLHHSQNLLRAVSNMLQKARQTLEFYPCTSEEIDHEDITKDKTSTVEACLPLELTKNESCINSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 813 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSHETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 814 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSQETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 815 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRQTSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 816 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRNTSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 817 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRHTSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 818 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSIITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 819 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSVITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 820 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCVASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 821 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCIASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 822 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASHKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 823 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASQKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 824 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRQTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 825 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRNTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 826 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYQDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 827 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYNDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 828 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYHDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 829 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLQMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 830 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLNMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 831 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKVYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 832 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKIYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 833 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVQFKTMNAKLLMDPKRQIFLDQNMLAVIDELMQALNFNSETVPQKSSLEEPDFYKTKIKLCILLHAFRIRAVTIDRVMSYLNAS

SEQ ID NO: 834 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVNFKTMNAKLLMDPKRQIFLDQNMLAVIDELMQALNFNSETVPQKSSLEEPDFYKTKIKLCILLHAFRIRAVTIDRVMSYLNAS

SEQ ID NO: 835 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVHFKTMNAKLLMDPKRQIFLDQNMLAVIDELMQALNFNSETVPQKSSLEEPDFYKTKIKLCILLHAFRIRAVTIDRVMSYLNAS

SEQ ID NO: 836 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFQTMNAKLLMDPKRQIFLDQNMLAVIDELMQALNFNSETVPQKSSLEEPDFYKTKIKLCILLHAFRIRAVTIDRVMSYLNAS

SEQ ID NO: 837 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFNTMNAKLLMDPKRQIFLDQNMLAVIDELMQALNFNSETVPQKSSLEEPDFYKTKIKLCILLHAFRIRAVTIDRVMSYLNAS

SEQ ID NO: 838 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLVMDPKRQIFLDQNMLAVIDELMQALNFNSETVPQKSSLEEPDFYKTKIKLCILLHAFRIRAVTIDRVMSYLNAS

SEQ ID NO: 839 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLIMDPKRQIFLDQNMLAVIDELMQALNFNSETVPQKSSLEEPDFYKTKIKLCILLHAFRIRAVTIDRVMSYLNAS

SEQ ID NO: 840 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLVDPKRQIFLDQNMLAVIDELMQALNFNSETVPQKSSLEEPDFYKTKIKLCILLHAFRIRAVTIDRVMSYLNAS

SEQ ID NO: 841 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLIDPKRQIFLDQNMLAVIDELMQALNFNSETVPQKSSLEEPDFYKTKIKLCILLHAFRIRAVTIDRVMSYLNAS

SEQ ID NO: 842 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDSKRQIFLDQNMLAVIDELMQALNFNSETVPQKSSLEEPDFYKTKIKLCILLHAFRIRAVTIDRVMSYLNAS

SEQ ID NO: 843 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDAKRQIFLDQNMLAVIDELMQALNFNSETVPQKSSLEEPDFYKTKIKLCILLHAFRIRAVTIDRVMSYLNAS

SEQ ID NO: 844 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPQRQIFLDQNMLAVIDELMQALNFNSETVPQKSSLEEPDFYKTKIKLCILLHAFRIRAVTIDRVMSYLNAS

SEQ ID NO: 845 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPNRQIFLDQNMLAVIDELMQALNFNSETVPQKSSLEEPDFYKTKIKLCILLHAFRIRAVTIDRVMSYLNAS

SEQ ID NO: 846 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKHQIFLDQNMLAVIDELMQALNFNSETVPQKSSLEEPDFYKTKIKLCILLHAFRIRAVTIDRVMSYLNAS

SEQ ID NO: 847 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKQQIFLDQNMLAVIDELMQALNFNSETVPQKSSLEEPDFYKTKIKLCILLHAFRIRAVTIDRVMSYLNAS

SEQ ID NO: 848 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDHVMSYLNAS

SEQ ID NO: 849 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDQVMSYLNAS

SEQ ID NO: 850 - protein, 191 aa, Homo sapiens
FPTIPLSRLFDNAMLRAHRLHQLAFDTYQEFEEAYIPKEQKYSFLQNPQTSLCFSQSIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 851 - protein, 191 aa, Homo sapiens
FPTIPLSRLFDNAMLRAHRLHQLAFDTYQEFEEAYIPKEQKYSFLQNPQTSLCFSNSIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 852 - protein, 191 aa, Homo sapiens
FPTIPLSRLFDNAMLRAHRLHQLAFDTYQEFEEAYIPKEQKYSFLQNPQTSLCFSHSIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 853 - protein, 191 aa, Homo sapiens
FPTIPLSRLFDNAMLRAHRLHQLAFDTYQEFEEAYIPKEQKYSFLQNPQTSLCFSESISTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 854 - protein, 191 aa, Homo sapiens
FPTIPLSRLFDNAMLRAHRLHQLAFDTYQEFEEAYIPKEQKYSFLQNPQTSLCFSESIATPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 855 - protein, 191 aa, Homo sapiens
FPTIPLSRLFDNAMLRAHRLHQLAFDTYQEFEEAYIPKEQKYSFLQNPQTSLCFSESIPTPSNHEETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 856 - protein, 191 aa, Homo sapiens
FPTIPLSRLFDNAMLRAHRLHQLAFDTYQEFEEAYIPKEQKYSFLQNPQTSLCFSESIPTPSNQEETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 857 - protein, 191 aa, Homo sapiens
FPTIPLSRLFDNAMLRAHRLHQLAFDTYQEFEEAYIPKEQKYSFLQNPQTSLCFSESIPTPSNRQETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 858 - protein, 191 aa, Homo sapiens
FPTIPLSRLFDNAMLRAHRLHQLAFDTYQEFEEAYIPKEQKYSFLQNPQTSLCFSESIPTPSNRNETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 859 - protein, 191 aa, Homo sapiens
FPTIPLSRLFDNAMLRAHRLHQLAFDTYQEFEEAYIPKEQKYSFLQNPQTSLCFSESIPTPSNRHETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 860 - protein, 191 aa, Homo sapiens
FPTIPLSRLFDNAMLRAHRLHQLAFDTYQEFEEAYIPKEQKYSFLQNPQTSLCFSESIPTPSNREQTQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 861 - protein, 191 aa, Homo sapiens
FPTIPLSRLFDNAMLRAHRLHQLAFDTYQEFEEAYIPKEQKYSFLQNPQTSLCFSESIPTPSNRENTQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 862 - protein, 191 aa, Homo sapiens
FPTIPLSRLFDNAMLRAHRLHQLAFDTYQEFEEAYIPKEQKYSFLQNPQTSLCFSESIPTPSNREHTQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 863 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLQPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 864 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLNPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 865 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLHPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 866 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQILRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 867 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQVLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 868 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLHSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 869 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLQSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 870 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSVVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 871 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSIVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 872 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLQDGSPRTGQIFKQTYSKFDTNSHNDDALLKNYGLLYCFRKDMDKVETFLRIVQCRSVEGSCGF

SEQ ID NO: 873 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLNDGSPRTGQIFKQTYSKFDTNSHNDDALLKNYGLLYCFRKDMDKVETFLRIVQCRSVEGSCGF

SEQ ID NO: 874 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLHDGSPRTGQIFKQTYSKFDTNSHNDDALLKNYGLLYCFRKDMDKVETFLRIVQCRSVEGSCGF

SEQ ID NO: 875 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEQGSPRTGQIFKQTYSKFDTNSHNDDALLKNYGLLYCFRKDMDKVETFLRIVQCRSVEGSCGF

SEQ ID NO: 876 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLENGSPRTGQIFKQTYSKFDTNSHNDDALLKNYGLLYCFRKDMDKVETFLRIVQCRSVEGSCGF

SEQ ID NO: 877 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSSRTGQIFKQTYSKFDTNSHNDDALLKNYGLLYCFRKDMDKVETFLRIVQCRSVEGSCGF

SEQ ID NO: 878 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSARTGQIFKQTYSKFDTNSHNDDALLKNYGLLYCFRKDMDKVETFLRIVQCRSVEGSCGF

SEQ ID NO: 879 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPHTGQIFKQTYSKFDTNSHNDDALLKNYGLLYCFRKDMDKVETFLRIVQCRSVEGSCGF

SEQ ID NO: 880 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPQTGQIFKQTYSKFDTNSHNDDALLKNYGLLYCFRKDMDKVETFLRIVQCRSVEGSCGF

SEQ ID NO: 881 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFQQTYSKFDTNSHNDDALLKNYGLLYCFRKDMDKVETFLRIVQCRSVEGSCGF

SEQ ID NO: 882 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFNQTYSKFDTNSHNDDALLKNYGLLYCFRKDMDKVETFLRIVQCRSVEGSCGF

SEQ ID NO: 883 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTHSKFDTNSHNDDALLKNYGLLYCFRKDMDKVETFLRIVQCRSVEGSCGF

SEQ ID NO: 884 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTISKFDTNSHNDDALLKNYGLLYCFRKDMDKVETFLRIVQCRSVEGSCGF

SEQ ID NO: 885 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSQFDTNSHNDDALLKNYGLLYCFRKDMDKVETFLRIVQCRSVEGSCGF

SEQ ID NO: 886 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSNFDTNSHNDDALLKNYGLLYCFRKDMDKVETFLRIVQCRSVEGSCGF

SEQ ID NO: 887 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKIDTNSHNDDALLKNYGLLYCFRKDMDKVETFLRIVQCRSVEGSCGF

SEQ ID NO: 888 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKVDTNSHNDDALLKNYGLLYCFRKDMDKVETFLRIVQCRSVEGSCGF

SEQ ID NO: 889 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFQTNSHNDDALLKNYGLLYCFRKDMDKVETFLRIVQCRSVEGSCGF

SEQ ID NO: 890 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFNTNSHNDDALLKNYGLLYCFRKDMDKVETFLRIVQCRSVEGSCGF

SEQ ID NO: 891 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCHSVEGSCGF

SEQ ID NO: 892 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCQSVEGSCGF

SEQ ID NO: 893 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVQGSCGF

SEQ ID NO: 894 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVNGSCGF

SEQ ID NO: 895 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVHGSCGF

SEQ ID NO: 896 - protein, 183 aa, Homo sapiens
VPPGEDSKDVAAPHRQPLTSSERIDKQIRYILDGISALRKETCNKSNMCESSKEALAENNLNLSKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 897 - protein, 183 aa, Homo sapiens
VPPGEDSKDVAAPHRQPLTSSERIDKQIRYILDGISALRKETCNKSNMCESSKEALAENNLNLAKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 898 - protein, 183 aa, Homo sapiens
VPPGEDSKDVAAPHRQPLTSSERIDKQIRYILDGISALRKETCNKSNMCESSKEALAENNLNLPQMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 899 - protein, 183 aa, Homo sapiens
VPPGEDSKDVAAPHRQPLTSSERIDKQIRYILDGISALRKETCNKSNMCESSKEALAENNLNLPNMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 900 - protein, 183 aa, Homo sapiens
VPPGEDSKDVAAPHRQPLTSSERIDKQIRYILDGISALRKETCNKSNMCESSKEALAENNLNLPKVAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 901 - protein, 183 aa, Homo sapiens
VPPGEDSKDVAAPHRQPLTSSERIDKQIRYILDGISALRKETCNKSNMCESSKEALAENNLNLPKIAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 902 - protein, 183 aa, Homo sapiens
VPPGEDSKDVAAPHRQPLTSSERIDKQIRYILDGISALRKETCNKSNMCESSKEALAENNLNLPKMAQKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 903 - protein, 183 aa, Homo sapiens
VPPGEDSKDVAAPHRQPLTSSERIDKQIRYILDGISALRKETCNKSNMCESSKEALAENNLNLPKMANKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 904 - protein, 183 aa, Homo sapiens
VPPGEDSKDVAAPHRQPLTSSERIDKQIRYILDGISALRKETCNKSNMCESSKEALAENNLNLPKMAHKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 905 - protein, 183 aa, Homo sapiens
VPPGEDSKDVAAPHRQPLTSSERIDKQIRYILDGISALRKETCNKSNMCESSKEALAENNLNLPKMAEQDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 906 - protein, 183 aa, Homo sapiens
VPPGEDSKDVAAPHRQPLTSSERIDKQIRYILDGISALRKETCNKSNMCESSKEALAENNLNLPKMAENDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 907 - protein, 183 aa, Homo sapiens
VPPGEDSKDVAAPHRQPLTSSERIDKQIRYILDGISALRKETCNKSNMCESSKEALAENNLNLPKMAEKDGCIQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 908 - protein, 183 aa, Homo sapiens
VPPGEDSKDVAAPHRQPLTSSERIDKQIRYILDGISALRKETCNKSNMCESSKEALAENNLNLPKMAEKDGCVQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 909 - protein, 183 aa, Homo sapiens
VPPGEDSKDVAAPHRQPLTSSERIDKQIRYILDGISALRKETCNKSNMCESSKEALAENNLNLPKMAEKDGCFQSGINEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 910 - protein, 183 aa, Homo sapiens
VPPGEDSKDVAAPHRQPLTSSERIDKQIRYILDGISALRKETCNKSNMCESSKEALAENNLNLPKMAEKDGCFQSGVNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 911 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLQFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 912 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLNFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 913 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLHFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 914 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLQYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 915 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLNYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 916 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLHYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 917 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNHFESSEEQARAVQMSTKVLIQFLQKKAKNLDAITTPDPTTNASLLTKLQAQNQWLQDMTTHLILRSFKEFLQSSLRALRQM

SEQ ID NO: 918 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNQFESSEEQARAVQMSTKVLIQFLQKKAKNLDAITTPDPTTNASLLTKLQAQNQWLQDMTTHLILRSFKEFLQSSLRALRQM

SEQ ID NO: 919 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFQSSEEQARAVQMSTKVLIQFLQKKAKNLDAITTPDPTTNASLLTKLQAQNQWLQDMTTHLILRSFKEFLQSSLRALRQM

SEQ ID NO: 920 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFNSSEEQARAVQMSTKVLIQFLQKKAKNLDAITTPDPTTNASLLTKLQAQNQWLQDMTTHLILRSFKEFLQSSLRALRQM

SEQ ID NO: 921 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFHSSEEQARAVQMSTKVLIQFLQKKAKNLDAITTPDPTTNASLLTKLQAQNQWLQDMTTHLILRSFKEFLQSSLRALRQM

SEQ ID NO: 922 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSQEQARAVQMSTKVLIQFLQKKAKNLDAITTPDPTTNASLLTKLQAQNQWLQDMTTHLILRSFKEFLQSSLRALRQM

SEQ ID NO: 923 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSNEQARAVQMSTKVLIQFLQKKAKNLDAITTPDPTTNASLLTKLQAQNQWLQDMTTHLILRSFKEFLQSSLRALRQM

SEQ ID NO: 924 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSHEQARAVQMSTKVLIQFLQKKAKNLDAITTPDPTTNASLLTKLQAQNQWLQDMTTHLILRSFKEFLQSSLRALRQM

SEQ ID NO: 925 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLQAITTPDPTTNASLLTKLQAQNQWLQDMTTHLILRSFKEFLQSSLRALRQM

SEQ ID NO: 926 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLNAITTPDPTTNASLLTKLQAQNQWLQDMTTHLILRSFKEFLQSSLRALRQM

SEQ ID NO: 927 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTSDPTTNASLLTKLQAQNQWLQDMTTHLILRSFKEFLQSSLRALRQM

SEQ ID NO: 928 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTADPTTNASLLTKLQAQNQWLQDMTTHLILRSFKEFLQSSLRALRQM

SEQ ID NO: 929 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPQPTTNASLLTKLQAQNQWLQDMTTHLILRSFKEFLQSSLRALRQM

SEQ ID NO: 930 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPNPTTNASLLTKLQAQNQWLQDMTTHLILRSFKEFLQSSLRALRQM

SEQ ID NO: 931 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDSTTNASLLTKLQAQNQWLQDMTTHLILRSFKEFLQSSLRALRQM

SEQ ID NO: 932 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDATTNASLLTKLQAQNQWLQDMTTHLILRSFKEFLQSSLRALRQM

SEQ ID NO: 933 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTQLQAQNQWLQDMTTHLILRSFKEFLQSSLRALRQM

SEQ ID NO: 934 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTNLQAQNQWLQDMTTHLILRSFKEFLQSSLRALRQM

SEQ ID NO: 935 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQSLQDMTTHLILRSFKEFLQSSLRALRQM

SEQ ID NO: 936 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQHLQDMTTHLILRSFKEFLQSSLRALRQM

SEQ ID NO: 937 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLHALRQM

SEQ ID NO: 938 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLQALRQM

SEQ ID NO: 939 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALHQM

SEQ ID NO: 940 - protein, 166 aa, Homo sapiens
APPRLICDSRVLERYLLEAKEAENITTGCAEHCSLNENITVPQTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 941 - protein, 166 aa, Homo sapiens
APPRLICDSRVLERYLLEAKEAENITTGCAEHCSLNENITVPNTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 942 - protein, 166 aa, Homo sapiens
APPRLICDSRVLERYLLEAKEAENITTGCAEHCSLNENITVPDTQVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 943 - protein, 166 aa, Homo sapiens
APPRLICDSRVLERYLLEAKEAENITTGCAEHCSLNENITVPDTNVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 944 - protein, 166 aa, Homo sapiens
APPRLICDSRVLERYLLEAKEAENITTGCAEHCSLNENITVPDTKVNIYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 945 - protein, 166 aa, Homo sapiens
APPRLICDSRVLERYLLEAKEAENITTGCAEHCSLNENITVPDTKVNVYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 946 - protein, 166 aa, Homo sapiens
APPRLICDSRVLERYLLEAKEAENITTGCAEHCSLNENITVPDTKVNFHAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 947 - protein, 166 aa, Homo sapiens
APPRLICDSRVLERYLLEAKEAENITTGCAEHCSLNENITVPDTKVNFIAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 948 - protein, 166 aa, Homo sapiens
APPRLICDSRVLERYLLEAKEAENITTGCAEHCSLNENITVPDTKVNFYAWQRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 949 - protein, 166 aa, Homo sapiens
APPRLICDSRVLERYLLEAKEAENITTGCAEHCSLNENITVPDTKVNFYAWNRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 950 - protein, 166 aa, Homo sapiens
APPRLICDSRVLERYLLEAKEAENITTGCAEHCSLNENITVPDTKVNFYAWKHMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 951 - protein, 166 aa, Homo sapiens
APPRLICDSRVLERYLLEAKEAENITTGCAEHCSLNENITVPDTKVNFYAWKQMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 952 - protein, 166 aa, Homo sapiens
APPRLICDSRVLERYLLEAKEAENITTGCAEHCSLNENITVPDTKVNFYAWKRMQVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 953 - protein, 166 aa, Homo sapiens
APPRLICDSRVLERYLLEAKEAENITTGCAEHCSLNENITVPDTKVNFYAWKRMNVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 954 - protein, 166 aa, Homo sapiens
APPRLICDSRVLERYLLEAKEAENITTGCAEHCSLNENITVPDTKVNFYAWKRMHVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 955 - protein, 166 aa, Homo sapiens
APPRLICDSRVLERYLLEAKEAENITTGCAEHCSLNENITVPDTKVNFYAWKRMEVGQQAVEVWQGLALLSQAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 956 - protein, 166 aa, Homo sapiens
APPRLICDSRVLERYLLEAKEAENITTGCAEHCSLNENITVPDTKVNFYAWKRMEVGQQAVEVWQGLALLSNAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 957 - protein, 166 aa, Homo sapiens
APPRLICDSRVLERYLLEAKEAENITTGCAEHCSLNENITVPDTKVNFYAWKRMEVGQQAVEVWQGLALLSHAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 958 - protein, 166 aa, Homo sapiens
APPRLICDSRVLERYLLEAKEAENITTGCAEHCSLNENITVPDTKVNFYAWKRMEVGQQAVEVWQGLALLSEAVVRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 959 - protein, 166 aa, Homo sapiens
APPRLICDSRVLERYLLEAKEAENITTGCAEHCSLNENITVPDTKVNFYAWKRMEVGQQAVEVWQGLALLSEAVIRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 960 - protein, 166 aa, Homo sapiens
APPRLICDSRVLERYLLEAKEAENITTGCAEHCSLNENITVPDTKVNFYAWKRMEVGQQAVEVWQGLALLSEAVLHGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 961 - protein, 166 aa, Homo sapiens
APPRLICDSRVLERYLLEAKEAENITTGCAEHCSLNENITVPDTKVNFYAWKRMEVGQQAVEVWQGLALLSEAVLQGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 962 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPQAASAAPLRTITADTFRKLFRVYSNFLRGKLKLYTGEACRTGDR

SEQ ID NO: 963 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPNAASAAPLRTITADTFRKLFRVYSNFLRGKLKLYTGEACRTGDR

SEQ ID NO: 964 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAASLRTITADTFRKLFRVYSNFLRGKLKLYTGEACRTGDR

SEQ ID NO: 965 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAALRTITADTFRKLFRVYSNFLRGKLKLYTGEACRTGDR

SEQ ID NO: 966 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPVRTITADTFRKLFRVYSNFLRGKLKLYTGEACRTGDR

SEQ ID NO: 967 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPIRTITADTFRKLFRVYSNFLRGKLKLYTGEACRTGDR

SEQ ID NO: 968 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLHTITADTFRKLFRVYSNFLRGKLKLYTGEACRTGDR

SEQ ID NO: 969 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLQTITADTFRKLFRVYSNFLRGKLKLYTGEACRTGDR

SEQ ID NO: 970 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACHTGDR

SEQ ID NO: 971 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACQTGDR

SEQ ID NO: 972 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGQR

SEQ ID NO: 973 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGNR

SEQ ID NO: 974 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISSPDAASAAPLRTITADTFRKLFRVYSNFLRGKLKLYTGEACHTGDR

SEQ ID NO: 975 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISAPDAASAAPLRTITADTFRKLFRVYSNFLRGKLKLYTGEACQTGDR

SEQ ID NO: 976 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPSDAASAAPLRTITADTFRKLFRVYSNFLRGKLKLYTGEACRTGQR

SEQ ID NO: 977 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPADAASAAPLRTITADTFRKLFRVYSNFLRGKLKLYTGEACRTGNR

SEQ ID NO: 978 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLVKEDSILAVRKYFQRITLYLKEKKYSPCAWEVVRAEIMRSFSLSTNLQESLRSKE

SEQ ID NO: 979 - protein, 165 aa, Homo sapiens
CDLPQTHSLGSRRTLMLLAQMRRISLFSCLKDRHDFGFPQHEFGDQFQKAETIPVLHEMIQQIFNLFSTKDSSAAWDETLLDKFYTELHQQLNDLEACVIQGVGVTETPLMKEDSILAVRKYFQRITLYLKEKKYSPCAWEVVRAEIMRSFSLSTNLQESLRSKE

SEQ ID NO: 980 - protein, 165 aa, Homo sapiens
CDLPQTHSLGSRRTLMLLAQMRRISLFSCLKDRHDFGFPQQEFGNQFQKAETIPVLHEMIQQIFNLFSTKDSSAAWDETLLDKFYTELYQQLNGLEACVIQGVGVTETPLMKEDSILAVRKYFQRITLYLKEKKYSPCAWEVVRAEIMRSFSLSTNLQESLRSKE

SEQ ID NO: 981 - protein, 165 aa, Homo sapiens
CDLPQTHSLGSRRTLMLLAQMRRISLVSCLKDRHDFGFPQEEFGNQFQKAETIPVLHQMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 982 - protein, 165 aa, Homo sapiens
CDLPQTHSLGSRRTLMLLAQMRRISLFSCLKDHHDFGFPQEEFGNQFQKAETIPVLHHMIQQIFNLFSTKDSSAAWDHTLLDKFYTELYQQLNDLEACVIQGVGVTETPVMKEDSILAVRKYFQRITLYLKEKKYSPCAWEVVRAEIMRSFSLSTNLQESLRSKE

SEQ ID NO: 983 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETALMKEDSILAVRQYFQRITLYLKEKKYSPCAWEVVRAEIMRSFSLSTNLQESLRSKE

SEQ ID NO: 984 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQRVGVTETALMKEDSILAVRQYFQRITLYLKEQKYSPCAWEVVRAEIMRSFSLSTNLQESLRSKE

SEQ ID NO: 985 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIVAVRKYFQRITLYLKEKKYSPCGWEVVRAEIMRSFSLSTNLQESLRSKE

SEQ ID NO: 986 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLVKEDSILAVRKYFQHITLYLKEKKYSPCAWEVVRAEIMRSFSLSTNLQESLRSKE

SEQ ID NO: 987 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELHQQLNDLEACVIQGVGVTETPLMKEDSILAVRKYFQRITLYLKEKKYSPCAWEVVRAEIMRSFSLSTNLQHSLRSKE

SEQ ID NO: 988 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIAGVGVTETPLMKEDSILAVRKYFQRITLYLKEKKYSPCAWEVVRAEIMRSFSLSTNLQESLRSKE

SEQ ID NO: 989 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLTRYYGRILHYLKAKEYSHCAWTIVRVEILRNFYFINRLTGYLRN

SEQ ID NO: 990 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLSRYYGRILHYLKAKEYSHCAWTIVRVEILRNFYFINRLTGYLRN

SEQ ID NO: 991 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLHRYYGRILHYLKAKEYSHCAWTIVRVEILRNFYFINRLTGYLRN

SEQ ID NO: 992 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKHYYGRILHYLKAKEYSHCAWTIVRVEILRNFYFINRLTGYLRN

SEQ ID NO: 993 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKQYYGRILHYLKAKEYSHCAWTIVRVEILRNFYFINRLTGYLRN

SEQ ID NO: 994 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGHILHYLKAKEYSHCAWTIVRVEILRNFYFINRLTGYLRN

SEQ ID NO: 995 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGQILHYLKAKEYSHCAWTIVRVEILRNFYFINRLTGYLRN

SEQ ID NO: 996 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRIVHYLKAKEYSHCAWTIVRVEILRNFYFINRLTGYLRN

SEQ ID NO: 997 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRIIHYLKAKEYSHCAWTIVRVEILRNFYFINRLTGYLRN

SEQ ID NO: 998 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRITHYLKAKEYSHCAWTIVRVEILRNFYFINRLTGYLRN

SEQ ID NO: 999 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRIQHYLKAKEYSHCAWTIVRVEILRNFYFINRLTGYLRN

SEQ ID NO: 1000 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRIHHYLKAKEYSHCAWTIVRVEILRNFYFINRLTGYLRN

SEQ ID NO: 1001 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRIAHYLKAKEYSHCAWTIVRVEILRNFYFINRLTGYLRN

SEQ ID NO: 1002 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLQAKEYSHCAWTIVRVEILRNFYFINRLTGYLRN

SEQ ID NO: 1003 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLTAKEYSHCAWTIVRVEILRNFYFINRLTGYLRN

SEQ ID NO: 1004 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLSAKEYSHCAWTIVRVEILRNFYFINRLTGYLRN

SEQ ID NO: 1005 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLHAKEYSHCAWTIVRVEILRNFYFINRLTGYLRN

SEQ ID NO: 1006 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAQEYSHCAWTIVRVEILRNFYFINRLTGYLRN

SEQ ID NO: 1007 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKATEYSHCAWTIVRVEILRNFYFINRLTGYLRN

SEQ ID NO: 1008 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKASEYSHCAWTIVRVEILRNFYFINRLTGYLRN

SEQ ID NO: 1009 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAHEYSHCAWTIVRVEILRNFYFINRLTGYLRN

SEQ ID NO: 1010 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKQYSHCAWTIVRVEILRNFYFINRLTGYLRN

SEQ ID NO: 1011 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKHYSHCAWTIVRVEILRNFYFINRLTGYLRN

SEQ ID NO: 1012 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGHLRN

SEQ ID NO: 1013 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGILRN

SEQ ID NO: 1014 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLHN

SEQ ID NO: 1015 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLQN

SEQ ID NO: 1016 - protein, 166 aa, Homo sapiens
VSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1017 - protein, 166 aa, Homo sapiens
ISYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1018 - protein, 166 aa, Homo sapiens
TSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1019 - protein, 166 aa, Homo sapiens
ASYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1020 - protein, 166 aa, Homo sapiens
MSYNVLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1021 - protein, 166 aa, Homo sapiens
MSYNILGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1022 - protein, 166 aa, Homo sapiens
MSYNTLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1023 - protein, 166 aa, Homo sapiens
MSYNQLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1024 - protein, 166 aa, Homo sapiens
MSYNHLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1025 - protein, 166 aa, Homo sapiens
MSYNALGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1026 - protein, 166 aa, Homo sapiens
MSYNLLGILQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1027 - protein, 166 aa, Homo sapiens
MSYNLLGVLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1028 - protein, 166 aa, Homo sapiens
MSYNLLGFVQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1029 - protein, 166 aa, Homo sapiens
MSYNLLGFIQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1030 - protein, 166 aa, Homo sapiens
MSYNLLGFTQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1031 - protein, 166 aa, Homo sapiens
MSYNLLGFQQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1032 - protein, 166 aa, Homo sapiens
MSYNLLGFHQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1033 - protein, 166 aa, Homo sapiens
MSYNLLGFAQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1034 - protein, 166 aa, Homo sapiens
MSYNLLGFLQHSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1035 - protein, 166 aa, Homo sapiens
MSYNLLGFLQQSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1036 - protein, 166 aa, Homo sapiens
MSYNLLGFLQRSSNIQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1037 - protein, 166 aa, Homo sapiens
MSYNLLGFLQRSSNVQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1038 - protein, 166 aa, Homo sapiens
MSYNLLGFLQRSSNFQCQQLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1039 - protein, 166 aa, Homo sapiens
MSYNLLGFLQRSSNFQCQTLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1040 - protein, 166 aa, Homo sapiens
MSYNLLGFLQRSSNFQCQSLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1041 - protein, 166 aa, Homo sapiens
MSYNLLGFLQRSSNFQCQHLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1042 - protein, 166 aa, Homo sapiens
MSYNLLGFLQRSSNFQCQKLLSQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1043 - protein, 166 aa, Homo sapiens
MSYNLLGFLQRSSNFQCQKLLHQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1044 - protein, 166 aa, Homo sapiens
MSYNLLGFLQRSSNFQCQKLLWQLHGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1045 - protein, 166 aa, Homo sapiens
MSYNLLGFLQRSSNFQCQKLLWQLSGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1046 - protein, 166 aa, Homo sapiens
MSYNLLGFLQRSSNFQCQKLLWQLQGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1047 - protein, 166 aa, Homo sapiens
MSYNLLGFLQRSSNFQCQKLLWQLNGHLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1048 - protein, 166 aa, Homo sapiens
MSYNLLGFLQRSSNFQCQKLLWQLNGQLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1049 - protein, 166 aa, Homo sapiens
MSYNLLGFLQRSSNFQCQKLLWQLNGRVEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1050 - protein, 166 aa, Homo sapiens
MSYNLLGFLQRSSNFQCQKLLWQLNGRIEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1051 - protein, 166 aa, Homo sapiens
MSYNLLGFLQRSSNFQCQKLLWQLNGRTEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1052 - protein, 166 aa, Homo sapiens
MSYNLLGFLQRSSNFQCQKLLWQLNGRQEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1053 - protein, 166 aa, Homo sapiens
MSYNLLGFLQRSSNFQCQKLLWQLNGRHEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1054 - protein, 166 aa, Homo sapiens
MSYNLLGFLQRSSNFQCQKLLWQLNGRAEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1055 - protein, 166 aa, Homo sapiens
MSYNLLGFLQRSSNFQCQKLLWQLNGRLQYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1056 - protein, 166 aa, Homo sapiens
MSYNLLGFLQRSSNFQCQKLLWQLNGRLHYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1057 - protein, 166 aa, Homo sapiens
MSYNLLGFLQRSSNFQCQKLLWQLNGRLEHCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1058 - protein, 166 aa, Homo sapiens
MSYNLLGFLQRSSNFQCQKLLWQLNGRLEICLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1059 - protein, 166 aa, Homo sapiens
MSYNLLGFLQRSSNFQCQKLLWQLNGRLEYCVKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1060 - protein, 166 aa, Homo sapiens
MSYNLLGFLQRSSNFQCQKLLWQLNGRLEYCIKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1061 - protein, 166 aa, Homo sapiens
MSYNLLGFLQRSSNFQCQKLLWQLNGRLEYCTKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1062 - protein, 166 aa, Homo sapiens
MSYNLLGFLQRSSNFQCQKLLWQLNGRLEYCQKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1063 - protein, 166 aa, Homo sapiens
MSYNLLGFLQRSSNFQCQKLLWQLNGRLEYCHKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1064 - protein, 166 aa, Homo sapiens
MSYNLLGFLQRSSNFQCQKLLWQLNGRLEYCAKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1065 - protein, 166 aa, Homo sapiens
QSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1066 - protein, 166 aa, Homo sapiens
MSYNLLGFLQRSSNFQCQKLLWQLNGRLEYCLQDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1067 - protein, 166 aa, Homo sapiens
MSYNLLGFLQRSSNFQCQKLLWQLNGRLEYCLTDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1068 - protein, 166 aa, Homo sapiens
MSYNLLGFLQRSSNFQCQKLLWQLNGRLEYCLSDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1069 - protein, 166 aa, Homo sapiens
MSYNLLGFLQRSSNFQCQKLLWQLNGRLEYCLHDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1070 - protein, 166 aa, Homo sapiens
MSYNLLGFLQRSSNFQCQKLLWQLNGRLEYCLKDHMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1071 - protein, 166 aa, Homo sapiens
MSYNLLGFLQRSSNFQCQKLLWQLNGRLEYCLKDQMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1072 - protein, 166 aa, Homo sapiens
MSYNLLGFLQRSSNFQCQKLLWQLNGRLEYCLKDRVNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1073 - protein, 166 aa, Homo sapiens
MSYNLLGFLQRSSNFQCQKLLWQLNGRLEYCLKDRINFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1074 - protein, 166 aa, Homo sapiens
MSYNLLGFLQRSSNFQCQKLLWQLNGRLEYCLKDRTNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1075 - protein, 166 aa, Homo sapiens
MSYNLLGFLQRSSNFQCQKLLWQLNGRLEYCLKDRQNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1076 - protein, 166 aa, Homo sapiens
MSYNLLGFLQRSSNFQCQKLLWQLNGRLEYCLKDRANFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1077 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVQNLLANVYHQINHLKTVLEEKLEKEDFTRGKLMSSLHLKRYYGRILHYLKAKEYSHCAWTIVRVEILRNFYFINRLTGYLRN

SEQ ID NO: 1078 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVHNLLANVYHQINHLKTVLEEKLEKEDFTRGKLMSSLHLKRYYGRILHYLKAKEYSHCAWTIVRVEILRNFYFINRLTGYLRN

SEQ ID NO: 1079 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVHHQINHLKTVLEEKLEKEDFTRGKLMSSLHLKRYYGRILHYLKAKEYSHCAWTIVRVEILRNFYFINRLTGYLRN

SEQ ID NO: 1080 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVIHQINHLKTVLEEKLEKEDFTRGKLMSSLHLKRYYGRILHYLKAKEYSHCAWTIVRVEILRNFYFINRLTGYLRN

SEQ ID NO: 1081 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLQTVLEEKLEKEDFTRGKLMSSLHLKRYYGRILHYLKAKEYSHCAWTIVRVEILRNFYFINRLTGYLRN

SEQ ID NO: 1082 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLTTVLEEKLEKEDFTRGKLMSSLHLKRYYGRILHYLKAKEYSHCAWTIVRVEILRNFYFINRLTGYLRN

SEQ ID NO: 1083 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLSTVLEEKLEKEDFTRGKLMSSLHLKRYYGRILHYLKAKEYSHCAWTIVRVEILRNFYFINRLTGYLRN

SEQ ID NO: 1084 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLHTVLEEKLEKEDFTRGKLMSSLHLKRYYGRILHYLKAKEYSHCAWTIVRVEILRNFYFINRLTGYLRN

SEQ ID NO: 1085 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLQEKLEKEDFTRGKLMSSLHLKRYYGRILHYLKAKEYSHCAWTIVRVEILRNFYFINRLTGYLRN

SEQ ID NO: 1086 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLHEKLEKEDFTRGKLMSSLHLKRYYGRILHYLKAKEYSHCAWTIVRVEILRNFYFINRLTGYLRN

SEQ ID NO: 1087 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEQKLEKEDFTRGKLMSSLHLKRYYGRILHYLKAKEYSHCAWTIVRVEILRNFYFINRLTGYLRN

SEQ ID NO: 1088 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEHKLEKEDFTRGKLMSSLHLKRYYGRILHYLKAKEYSHCAWTIVRVEILRNFYFINRLTGYLRN

SEQ ID NO: 1089 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEQLEKEDFTRGKLMSSLHLKRYYGRILHYLKAKEYSHCAWTIVRVEILRNFYFINRLTGYLRN

SEQ ID NO: 1090 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEETLEKEDFTRGKLMSSLHLKRYYGRILHYLKAKEYSHCAWTIVRVEILRNFYFINRLTGYLRN

SEQ ID NO: 1091 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEESLEKEDFTRGKLMSSLHLKRYYGRILHYLKAKEYSHCAWTIVRVEILRNFYFINRLTGYLRN

SEQ ID NO: 1092 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEHLEKEDFTRGKLMSSLHLKRYYGRILHYLKAKEYSHCAWTIVRVEILRNFYFINRLTGYLRN

SEQ ID NO: 1093 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEHSHCAWTIVRVEILRNFYFINRLTGYLRN

SEQ ID NO: 1094 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEISHCAWTIVRVEILRNFYFINRLTGYLRN

SEQ ID NO: 1095 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILHNFYFINRLTGYLRN

SEQ ID NO: 1096 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILQNFYFINRLTGYLRN

SEQ ID NO: 1097 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFHFINRLTGYLRN

SEQ ID NO: 1098 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFIFINRLTGYLRN

SEQ ID NO: 1099 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINHLTGYLRN

SEQ ID NO: 1100 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINQLTGYLRN

SEQ ID NO: 1101 - protein, 166 aa, Homo sapiens
DSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1102 - protein, 166 aa, Homo sapiens
ESYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1103 - protein, 166 aa, Homo sapiens
KSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1104 - protein, 166 aa, Homo sapiens
NSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1105 - protein, 166 aa, Homo sapiens
RSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1106 - protein, 166 aa, Homo sapiens
SSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1107 - protein, 166 aa, Homo sapiens
MSYNDLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1108 - protein, 166 aa, Homo sapiens
MSYNELGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1109 - protein, 166 aa, Homo sapiens
MSYNKLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1110 - protein, 166 aa, Homo sapiens
MSYNRLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1111 - protein, 166 aa, Homo sapiens
MSYNNLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1112 - protein, 166 aa, Homo sapiens
MSYNSLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1113 - protein, 166 aa, Homo sapiens
MSYNLDGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1114 - protein, 166 aa, Homo sapiens
MSYNLEGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1115 - protein, 166 aa, Homo sapiens
MSYNLKGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1116 - protein, 166 aa, Homo sapiens
MSYNLNGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1117 - protein, 166 aa, Homo sapiens
MSYNLQGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1118 - protein, 166 aa, Homo sapiens
MSYNLRGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1119 - protein, 166 aa, Homo sapiens
MSYNLSGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1120 - protein, 166 aa, Homo sapiens
MSYNLTGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1121 - protein, 166 aa, Homo sapiens
MSYNLLGDLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1122 - protein, 166 aa, Homo sapiens
MSYNLLGELQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1123 - protein, 166 aa, Homo sapiens
MSYNLLGKLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1124 - protein, 166 aa, Homo sapiens
MSYNLLGRLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1125 - protein, 166 aa, Homo sapiens
MSYNLLGFDQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1126 - protein, 166 aa, Homo sapiens
MSYNLLGFEQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1127 - protein, 166 aa, Homo sapiens
MSYNLLGFKQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1128 - protein, 166 aa, Homo sapiens
MSYNLLGFNQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1129 - protein, 166 aa, Homo sapiens
MSYNLLGFRQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1130 - protein, 166 aa, Homo sapiens
MSYNLLGFSQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1131 - protein, 166 aa, Homo sapiens
MSYNLLGFLDRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1132 - protein, 166 aa, Homo sapiens
MSYNLLGFLERSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1133 - protein, 166 aa, Homo sapiens
MSYNLLGFLKRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1134 - protein, 166 aa, Homo sapiens
MSYNLLGFLNRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1135 - protein, 166 aa, Homo sapiens
MSYNLLGFLRRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1136 - protein, 166 aa, Homo sapiens
MSYNLLGFLSRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1137 - protein, 166 aa, Homo sapiens
MSYNLLGFLTRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1138 - protein, 166 aa, Homo sapiens
MSYNLLGFLQRDSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1139 - protein, 166 aa, Homo sapiens
MSYNLLGFLQRESNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1140 - protein, 166 aa, Homo sapiens
MSYNLLGFLQRKSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1141 - protein, 166 aa, Homo sapiens
MSYNLLGFLQRRSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1142 - protein, 166 aa, Homo sapiens
MSYNLLGFLQRSDNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1143 - protein, 166 aa, Homo sapiens
MSYNLLGFLQRSENFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1144 - protein, 166 aa, Homo sapiens
MSYNLLGFLQRSKNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1145 - protein, 166 aa, Homo sapiens
MSYNLLGFLQRSNNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1146 - protein, 166 aa, Homo sapiens
MSYNLLGFLQRSQNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1147 - protein, 166 aa, Homo sapiens [sequence omitted]

SEQ ID NO: 1148 - protein, 166 aa, Homo sapiens
MSYNLLGFLQRSTNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1149 - protein, 166 aa, Homo sapiens
MSYNLLGFLQRSSDFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1150 - protein, 166 aa, Homo sapiens
MSYNLLGFLQRSSEFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1151 - protein, 166 aa, Homo sapiens
MSYNLLGFLQRSSKFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1152 - protein, 166 aa, Homo sapiens
MSYNLLGFLQRSSQFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1153 - protein, 166 aa, Homo sapiens
MSYNLLGFLQRSSRFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1154 - protein, 166 aa, Homo sapiens
MSYNLLGFLQRSSSFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1155 - protein, 166 aa, Homo sapiens
MSYNLLGFLQRSSTFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1156 - protein, 166 aa, Homo sapiens
MSYNLLGFLQRSSNDQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1157 - protein, 166 aa, Homo sapiens
MSYNLLGFLQRSSNEQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1158 - protein, 166 aa, Homo sapiens
MSYNLLGFLQRSSNKQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1159 - protein, 166 aa, Homo sapiens
MSYNLLGFLQRSSNRQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1160 - protein, 166 aa, Homo sapiens
MSYNLLGFLQRSSNFDCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1161 - protein, 166 aa, Homo sapiens
MSYNLLGFLQRSSNFECQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1162 - protein, 166 aa, Homo sapiens
MSYNLLGFLQRSSNFKCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1163 - protein, 166 aa, Homo sapiens
MSYNLLGFLQRSSNFNCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1164 - protein, 166 aa, Homo sapiens
MSYNLLGFLQRSSNFRCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1165 - protein, 166 aa, Homo sapiens
MSYNLLGFLQRSSNFSCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1166 - protein, 166 aa, Homo sapiens
MSYNLLGFLQRSSNFTCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1167 - protein, 166 aa, Homo sapiens
MSYNLLGFLQRSSNFQDQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1168 - protein, 166 aa, Homo sapiens
MSYNLLGFLQRSSNFQEQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1169 - protein, 166 aa, Homo sapiens
MSYNLLGFLQRSSNFQKQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1170 - protein, 166 aa, Homo sapiens
MSYNLLGFLQRSSNFQNQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1171 - protein, 166 aa, Homo sapiens
MSYNLLGFLQRSSNFQQQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1172 - protein, 166 aa, Homo sapiens
MSYNLLGFLQRSSNFQRQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1173 - protein, 166 aa, Homo sapiens
MSYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1174 - protein, 166 aa, Homo sapiens
MSYNLLGFLQRSSNFQTQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1175 - protein, 166 aa, Homo sapiens
MSYNLLGFLQRSSNFQCQKNLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1176 - protein, 166 aa, Homo sapiens
MSYNLLGFLQRSSNFQCQKQLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1177 - protein, 166 aa, Homo sapiens
MSYNLLGFLQRSSNFQCQKRLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1178 - protein, 166 aa, Homo sapiens
MSYNLLGFLQRSSNFQCQKSLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1179 - protein, 166 aa, Homo sapiens
MSYNLLGFLQRSSNFQCQKTLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1180 - protein, 166 aa, Homo sapiens
MSYNLLGFLQRSSNFQCQKDLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1181 - protein, 166 aa, Homo sapiens
MSYNLLGFLQRSSNFQCQKELWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1182 - protein, 166 aa, Homo sapiens
MSYNLLGFLQRSSNFQCQKKLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1183 - protein, 166 aa, Homo sapiens
MSYNLLGFLQRSSNFQCQKLLDQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1184 - protein, 166 aa, Homo sapiens
MSYNLLGFLQRSSNFQCQKLLEQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1185 - protein, 166 aa, Homo sapiens
MSYNLLGFLQRSSNFQCQKLLKQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1186 - protein, 166 aa, Homo sapiens
MSYNLLGFLQRSSNFQCQKLLRQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1187 - protein, 166 aa, Homo sapiens
MSYNLLGFLQRSSNFQCQKLLWDLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1188 - protein, 166 aa, Homo sapiens
MSYNLLGFLQRSSNFQCQKLLWELNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1189 - protein, 166 aa, Homo sapiens
MSYNLLGFLQRSSNFQCQKLLWKLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1190 - protein, 166 aa, Homo sapiens
MSYNLLGFLQRSSNFQCQKLLWRLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1191 - protein, 166 aa, Homo sapiens
MSYNLLGFLQRSSNFQCQKLLWQDNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1192 - protein, 166 aa, Homo sapiens
MSYNLLGFLQRSSNFQCQKLLWQENGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1193 - protein, 166 aa, Homo sapiens
MSYNLLGFLQRSSNFQCQKLLWQKNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1194 - protein, 166 aa, Homo sapiens
MSYNLLGFLQRSSNFQCQKLLWQRNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1195 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTDWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1196 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTEWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1197 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTKWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1198 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTRWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1199 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGDNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1200 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGENETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1201 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGKNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1202 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGRNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1203 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWDETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1204 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWEETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1205 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWKETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1206 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWRETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1207 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNEDIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1208 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNEEIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1209 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNEKIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1210 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNERIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1211 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETDVENLLANVYHQINHLKTVLEEKLEKEDFTRGKLMSSLHLKRYYGRILHYLKAKEYSHCAWTIVRVEILRNFYFINRLTGYLRN

SEQ ID NO: 1212 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETEVENLLANVYHQINHLKTVLEEKLEKEDFTRGKLMSSLHLKRYYGRILHYLKAKEYSHCAWTIVRVEILRNFYFINRLTGYLRN

SEQ ID NO: 1213 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETKVENLLANVYHQINHLKTVLEEKLEKEDFTRGKLMSSLHLKRYYGRILHYLKAKEYSHCAWTIVRVEILRNFYFINRLTGYLRN

SEQ ID NO: 1214 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETRVENLLANVYHQINHLKTVLEEKLEKEDFTRGKLMSSLHLKRYYGRILHYLKAKEYSHCAWTIVRVEILRNFYFINRLTGYLRN

SEQ ID NO: 1215 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETNVENLLANVYHQINHLKTVLEEKLEKEDFTRGKLMSSLHLKRYYGRILHYLKAKEYSHCAWTIVRVEILRNFYFINRLTGYLRN

SEQ ID NO: 1216 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETQVENLLANVYHQINHLKTVLEEKLEKEDFTRGKLMSSLHLKRYYGRILHYLKAKEYSHCAWTIVRVEILRNFYFINRLTGYLRN

SEQ ID NO: 1217 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETSVENLLANVYHQINHLKTVLEEKLEKEDFTRGKLMSSLHLKRYYGRILHYLKAKEYSHCAWTIVRVEILRNFYFINRLTGYLRN

SEQ ID NO: 1218 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETTVENLLANVYHQINHLKTVLEEKLEKEDFTRGKLMSSLHLKRYYGRILHYLKAKEYSHCAWTIVRVEILRNFYFINRLTGYLRN

SEQ ID NO: 1219 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVEDLLANVYHQINHLKTVLEEKLEKEDFTRGKLMSSLHLKRYYGRILHYLKAKEYSHCAWTIVRVEILRNFYFINRLTGYLRN

SEQ ID NO: 1220 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVEELLANVYHQINHLKTVLEEKLEKEDFTRGKLMSSLHLKRYYGRILHYLKAKEYSHCAWTIVRVEILRNFYFINRLTGYLRN

SEQ ID NO: 1221 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVEKLLANVYHQINHLKTVLEEKLEKEDFTRGKLMSSLHLKRYYGRILHYLKAKEYSHCAWTIVRVEILRNFYFINRLTGYLRN

SEQ ID NO: 1222 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVERLLANVYHQINHLKTVLEEKLEKEDFTRGKLMSSLHLKRYYGRILHYLKAKEYSHCAWTIVRVEILRNFYFINRLTGYLRN

SEQ ID NO: 1223 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVEQLLANVYHQINHLKTVLEEKLEKEDFTRGKLMSSLHLKRYYGRILHYLKAKEYSHCAWTIVRVEILRNFYFINRLTGYLRN

SEQ ID NO: 1224 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVESLLANVYHQINHLKTVLEEKLEKEDFTRGKLMSSLHLKRYYGRILHYLKAKEYSHCAWTIVRVEILRNFYFINRLTGYLRN

SEQ ID NO: 1225 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVETLLANVYHQINHLKTVLEEKLEKEDFTRGKLMSSLHLKRYYGRILHYLKAKEYSHCAWTIVRVEILRNFYFINRLTGYLRN

SEQ ID NO: 1226 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENDLANVYHQINHLKTVLEEKLEKEDFTRGKLMSSLHLKRYYGRILHYLKAKEYSHCAWTIVRVEILRNFYFINRLTGYLRN

SEQ ID NO: 1227 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENELANVYHQINHLKTVLEEKLEKEDFTRGKLMSSLHLKRYYGRILHYLKAKEYSHCAWTIVRVEILRNFYFINRLTGYLRN

SEQ ID NO: 1228 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENKLANVYHQINHLKTVLEEKLEKEDFTRGKLMSSLHLKRYYGRILHYLKAKEYSHCAWTIVRVEILRNFYFINRLTGYLRN

SEQ ID NO: 1229 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENRLANVYHQINHLKTVLEEKLEKEDFTRGKLMSSLHLKRYYGRILHYLKAKEYSHCAWTIVRVEILRNFYFINRLTGYLRN

SEQ ID NO: 1230 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENNLANVYHQINHLKTVLEEKLEKEDFTRGKLMSSLHLKRYYGRILHYLKAKEYSHCAWTIVRVEILRNFYFINRLTGYLRN

SEQ ID NO: 1231 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENQLANVYHQINHLKTVLEEKLEKEDFTRGKLMSSLHLKRYYGRILHYLKAKEYSHCAWTIVRVEILRNFYFINRLTGYLRN

SEQ ID NO: 1232 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENSLANVYHQINHLKTVLEEKLEKEDFTRGKLMSSLHLKRYYGRILHYLKAKEYSHCAWTIVRVEILRNFYFINRLTGYLRN

SEQ ID NO: 1233 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENTLANVYHQINHLKTVLEEKLEKEDFTRGKLMSSLHLKRYYGRILHYLKAKEYSHCAWTIVRVEILRNFYFINRLTGYLRN

SEQ ID NO: 1234 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLDNVYHQINHLKTVLEEKLEKEDFTRGKLMSSLHLKRYYGRILHYLKAKEYSHCAWTIVRVEILRNFYFINRLTGYLRN

SEQ ID NO: 1235 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLENVYHQINHLKTVLEEKLEKEDFTRGKLMSSLHLKRYYGRILHYLKAKEYSHCAWTIVRVEILRNFYFINRLTGYLRN

SEQ ID NO: 1236 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLKNVYHQINHLKTVLEEKLEKEDFTRGKLMSSLHLKRYYGRILHYLKAKEYSHCAWTIVRVEILRNFYFINRLTGYLRN

SEQ ID NO: 1237 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLRNVYHQINHLKTVLEEKLEKEDFTRGKLMSSLHLKRYYGRILHYLKAKEYSHCAWTIVRVEILRNFYFINRLTGYLRN

SEQ ID NO: 1238 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLADVYHQINHLKTVLEEKLEKEDFTRGKLMSSLHLKRYYGRILHYLKAKEYSHCAWTIVRVEILRNFYFINRLTGYLRN

SEQ ID NO: 1239 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLAEVYHQINHLKTVLEEKLEKEDFTRGKLMSSLHLKRYYGRILHYLKAKEYSHCAWTIVRVEILRNFYFINRLTGYLRN

SEQ ID NO: 1240 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLAKVYHQINHLKTVLEEKLEKEDFTRGKLMSSLHLKRYYGRILHYLKAKEYSHCAWTIVRVEILRNFYFINRLTGYLRN

SEQ ID NO: 1241 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLAQVYHQINHLKTVLEEKLEKEDFTRGKLMSSLHLKRYYGRILHYLKAKEYSHCAWTIVRVEILRNFYFINRLTGYLRN

SEQ ID NO: 1242 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLARVYHQINHLKTVLEEKLEKEDFTRGKLMSSLHLKRYYGRILHYLKAKEYSHCAWTIVRVEILRNFYFINRLTGYLRN

SEQ ID NO: 1243 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLASVYHQINHLKTVLEEKLEKEDFTRGKLMSSLHLKRYYGRILHYLKAKEYSHCAWTIVRVEILRNFYFINRLTGYLRN

SEQ ID NO: 1244 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLATVYHQINHLKTVLEEKLEKEDFTRGKLMSSLHLKRYYGRILHYLKAKEYSHCAWTIVRVEILRNFYFINRLTGYLRN

SEQ ID NO: 1245 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANDYHQINHLKTVLEEKLEKEDFTRGKLMSSLHLKRYYGRILHYLKAKEYSHCAWTIVRVEILRNFYFINRLTGYLRN

SEQ ID NO: 1246 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANEYHQINHLKTVLEEKLEKEDFTRGKLMSSLHLKRYYGRILHYLKAKEYSHCAWTIVRVEILRNFYFINRLTGYLRN

SEQ ID NO: 1247 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANKYHQINHLKTVLEEKLEKEDFTRGKLMSSLHLKRYYGRILHYLKAKEYSHCAWTIVRVEILRNFYFINRLTGYLRN

SEQ ID NO: 1248 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANNYHQINHLKTVLEEKLEKEDFTRGKLMSSLHLKRYYGRILHYLKAKEYSHCAWTIVRVEILRNFYFINRLTGYLRN

SEQ ID NO: 1249 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANQYHQINHLKTVLEEKLEKEDFTRGKLMSSLHLKRYYGRILHYLKAKEYSHCAWTIVRVEILRNFYFINRLTGYLRN

SEQ ID NO: 1250 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANRYHQINHLKTVLEEKLEKEDFTRGKLMSSLHLKRYYGRILHYLKAKEYSHCAWTIVRVEILRNFYFINRLTGYLRN

SEQ ID NO: 1251 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANSYHQINHLKTVLEEKLEKEDFTRGKLMSSLHLKRYYGRILHYLKAKEYSHCAWTIVRVEILRNFYFINRLTGYLRN

SEQ ID NO: 1252 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANTYHQINHLKTVLEEKLEKEDFTRGKLMSSLHLKRYYGRILHYLKAKEYSHCAWTIVRVEILRNFYFINRLTGYLRN

SEQ ID NO: 1253 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHDINHLKTVLEEKLEKEDFTRGKLMSSLHLKRYYGRILHYLKAKEYSHCAWTIVRVEILRNFYFINRLTGYLRN

SEQ ID NO: 1254 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHEINHLKTVLEEKLEKEDFTRGKLMSSLHLKRYYGRILHYLKAKEYSHCAWTIVRVEILRNFYFINRLTGYLRN

SEQ ID NO: 1255 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHKINHLKTVLEEKLEKEDFTRGKLMSSLHLKRYYGRILHYLKAKEYSHCAWTIVRVEILRNFYFINRLTGYLRN

SEQ ID NO: 1256 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHNINHLKTVLEEKLEKEDFTRGKLMSSLHLKRYYGRILHYLKAKEYSHCAWTIVRVEILRNFYFINRLTGYLRN

SEQ ID NO: 1257 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHRINHLKTVLEEKLEKEDFTRGKLMSSLHLKRYYGRILHYLKAKEYSHCAWTIVRVEILRNFYFINRLTGYLRN

SEQ ID NO: 1258 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHSINHLKTVLEEKLEKEDFTRGKLMSSLHLKRYYGRILHYLKAKEYSHCAWTIVRVEILRNFYFINRLTGYLRN

SEQ ID NO: 1259 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHTINHLKTVLEEKLEKEDFTRGKLMSSLHLKRYYGRILHYLKAKEYSHCAWTIVRVEILRNFYFINRLTGYLRN

SEQ ID NO: 1260 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQDNHLKTVLEEKLEKEDFTRGKLMSSLHLKRYYGRILHYLKAKEYSHCAWTIVRVEILRNFYFINRLTGYLRN

SEQ ID NO: 1261 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQENHLKTVLEEKLEKEDFTRGKLMSSLHLKRYYGRILHYLKAKEYSHCAWTIVRVEILRNFYFINRLTGYLRN

SEQ ID NO: 1262 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQKNHLKTVLEEKLEKEDFTRGKLMSSLHLKRYYGRILHYLKAKEYSHCAWTIVRVEILRNFYFINRLTGYLRN

SEQ ID NO: 1263 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQNNHLKTVLEEKLEKEDFTRGKLMSSLHLKRYYGRILHYLKAKEYSHCAWTIVRVEILRNFYFINRLTGYLRN

SEQ ID NO: 1264 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQQNHLKTVLEEKLEKEDFTRGKLMSSLHLKRYYGRILHYLKAKEYSHCAWTIVRVEILRNFYFINRLTGYLRN

SEQ ID NO: 1265 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQRNHLKTVLEEKLEKEDFTRGKLMSSLHLKRYYGRILHYLKAKEYSHCAWTIVRVEILRNFYFINRLTGYLRN

SEQ ID NO: 1266 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQSNHLKTVLEEKLEKEDFTRGKLMSSLHLKRYYGRILHYLKAKEYSHCAWTIVRVEILRNFYFINRLTGYLRN

SEQ ID NO: 1267 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQTNHLKTVLEEKLEKEDFTRGKLMSSLHLKRYYGRILHYLKAKEYSHCAWTIVRVEILRNFYFINRLTGYLRN

SEQ ID NO: 1268 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINDLKTVLEEKLEKEDFTRGKLMSSLHLKRYYGRILHYLKAKEYSHCAWTIVRVEILRNFYFINRLTGYLRN

SEQ ID NO: 1269 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINELKTVLEEKLEKEDFTRGKLMSSLHLKRYYGRILHYLKAKEYSHCAWTIVRVEILRNFYFINRLTGYLRN

SEQ ID NO: 1270 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINKLKTVLEEKLEKEDFTRGKLMSSLHLKRYYGRILHYLKAKEYSHCAWTIVRVEILRNFYFINRLTGYLRN

SEQ ID NO: 1271 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINNLKTVLEEKLEKEDFTRGKLMSSLHLKRYYGRILHYLKAKEYSHCAWTIVRVEILRNFYFINRLTGYLRN

SEQ ID NO: 1272 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINQLKTVLEEKLEKEDFTRGKLMSSLHLKRYYGRILHYLKAKEYSHCAWTIVRVEILRNFYFINRLTGYLRN

SEQ ID NO: 1273 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINRLKTVLEEKLEKEDFTRGKLMSSLHLKRYYGRILHYLKAKEYSHCAWTIVRVEILRNFYFINRLTGYLRN

SEQ ID NO: 1274 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINSLKTVLEEKLEKEDFTRGKLMSSLHLKRYYGRILHYLKAKEYSHCAWTIVRVEILRNFYFINRLTGYLRN

SEQ ID NO: 1275 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINTLKTVLEEKLEKEDFTRGKLMSSLHLKRYYGRILHYLKAKEYSHCAWTIVRVEILRNFYFINRLTGYLRN

SEQ ID NO: 1276 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHDKTVLEEKLEKEDFTRGKLMSSLHLKRYYGRILHYLKAKEYSHCAWTIVRVEILRNFYFINRLTGYLRN

SEQ ID NO: 1277 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHEKTVLEEKLEKEDFTRGKLMSSLHLKRYYGRILHYLKAKEYSHCAWTIVRVEILRNFYFINRLTGYLRN

SEQ ID NO: 1278 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHKKTVLEEKLEKEDFTRGKLMSSLHLKRYYGRILHYLKAKEYSHCAWTIVRVEILRNFYFINRLTGYLRN

SEQ ID NO: 1279 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHNKTVLEEKLEKEDFTRGKLMSSLHLKRYYGRILHYLKAKEYSHCAWTIVRVEILRNFYFINRLTGYLRN

SEQ ID NO: 1280 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHQKTVLEEKLEKEDFTRGKLMSSLHLKRYYGRILHYLKAKEYSHCAWTIVRVEILRNFYFINRLTGYLRN

SEQ ID NO: 1281 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHRKTVLEEKLEKEDFTRGKLMSSLHLKRYYGRILHYLKAKEYSHCAWTIVRVEILRNFYFINRLTGYLRN

SEQ ID NO: 1282 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHSKTVLEEKLEKEDFTRGKLMSSLHLKRYYGRILHYLKAKEYSHCAWTIVRVEILRNFYFINRLTGYLRN

SEQ ID NO: 1283 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHTKTVLEEKLEKEDFTRGKLMSSLHLKRYYGRILHYLKAKEYSHCAWTIVRVEILRNFYFINRLTGYLRN

SEQ ID NO: 1284 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTDLEEKLEKEDFTRGKLMSSLHLKRYYGRILHYLKAKEYSHCAWTIVRVEILRNFYFINRLTGYLRN

SEQ ID NO: 1285 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTELEEKLEKEDFTRGKLMSSLHLKRYYGRILHYLKAKEYSHCAWTIVRVEILRNFYFINRLTGYLRN

SEQ ID NO: 1286 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTKLEEKLEKEDFTRGKLMSSLHLKRYYGRILHYLKAKEYSHCAWTIVRVEILRNFYFINRLTGYLRN

SEQ ID NO: 1287 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTNLEEKLEKEDFTRGKLMSSLHLKRYYGRILHYLKAKEYSHCAWTIVRVEILRNFYFINRLTGYLRN

SEQ ID NO: 1288 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTQLEEKLEKEDFTRGKLMSSLHLKRYYGRILHYLKAKEYSHCAWTIVRVEILRNFYFINRLTGYLRN

SEQ ID NO: 1289 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTRLEEKLEKEDFTRGKLMSSLHLKRYYGRILHYLKAKEYSHCAWTIVRVEILRNFYFINRLTGYLRN

SEQ ID NO: 1290 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTSLEEKLEKEDFTRGKLMSSLHLKRYYGRILHYLKAKEYSHCAWTIVRVEILRNFYFINRLTGYLRN

SEQ ID NO: 1291 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTTLEEKLEKEDFTRGKLMSSLHLKRYYGRILHYLKAKEYSHCAWTIVRVEILRNFYFINRLTGYLRN

SEQ ID NO: 1292 - protein, 166 aa, Homo sapiens
CSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1293 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTCLEEKLEKEDFTRGKLMSSLHLKRYYGRILHYLKAKEYSHCAWTIVRVEILRNFYFINRLTGYLRN

SEQ ID NO: 1294 - protein, 166 aa, Homo sapiens
MSYNLCGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1295 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHCKTVLEEKLEKEDFTRGKLMSSLHLKRYYGRILHYLKAKEYSHCAWTIVRVEILRNFYFINRLTGYLRN

SEQ ID NO: 1296 - protein, 166 aa, Homo sapiens
MSYNLLGFLCRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1297 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINCLKTVLEEKLEKEDFTRGKLMSSLHLKRYYGRILHYLKAKEYSHCAWTIVRVEILRNFYFINRLTGYLRN

SEQ ID NO: 1298 - protein, 166 aa, Homo sapiens
MSYNLLGFLQRSCNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1299 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHCINHLKTVLEEKLEKEDFTRGKLMSSLHLKRYYGRILHYLKAKEYSHCAWTIVRVEILRNFYFINRLTGYLRN

SEQ ID NO: 1300 - protein, 166 aa, Homo sapiens
MSYNLLGFLQRSSNFCCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1301 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLACVYHQINHLKTVLEEKLEKEDFTRGKLMSSLHLKRYYGRILHYLKAKEYSHCAWTIVRVEILRNFYFINRLTGYLRN

SEQ ID NO: 1302 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANCYHQINHLKTVLEEKLEKEDFTRGKLMSSLHLKRYYGRILHYLKAKEYSHCAWTIVRVEILRNFYFINRLTGYLRN

SEQ ID NO: 1303 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELHQQLNDLEACVIQGVGVTETPLMKEDSILAVRKYFQRITLYLKEKKYSPCAWEVVRAEIMRSFSLSTNLQESLRSKE

SEQ ID NO: 1304 - DNA, 46 bp, Artificial Sequence
  primer reverse IFNA-E159H
aaggatcctcattccttacttcttaaactgtgttgcaagtttgttg

SEQ ID NO: 1305 - DNA, 46 bp, Artificial Sequence
  primer reverse IFNA-E159Q
aaggatcctcattccttacttcttaaactctgttgcaagtttgttg

SEQ ID NO: 1306 - DNA, 41 bp, Artificial Sequence
  primer reverse IFNA-E159Q
aacatatgtgtgatctgcctcaaacccacagcctgggtagc

What is claimed is:

1. A method for generating a cytokine having a predetermined property or activity, the method comprising:
   (a) identifying, within a target cytokine or plurality thereof, target amino acids, wherein:
   each target amino acid is designated an in silico-HIT (is-HIT); and
   the is-HIT target amino acids are identified by identifying structurally homologous loci between the target cytokine and a reference cytokine possessing a predetermined activity, wherein:
   the predetermined property or activity is resistance to proteolysis; and
   identification of the structurally homologous loci between the target cytokine and the reference cytokine possessing the predetermined activity is effected by:
      (i) comparing the 3-dimensional structures of the two or more proteins to identify regions of high coincidence between their backbones, said regions designated as structurally homologous regions, wherein the degree of coincidence between the 3-dimensional structures of the target cytokine and of the reference cytokine is determined by superposition and root means squared (RMS) deviation calculations using any combination of one or more of the peptide backbone atoms selected from the group consisting of: N, C, C(C=O), O and CA: and
      (ii) identifying is-HIT structurally homologous loci on the target cytokine that correspond to structurally related is-HIT amino acid positions within a structurally homologous region of the reference cytokine;
   (b) identifying one or more replacement amino acids, specific for each is-HIT, wherein:
   each cytokine comprising a single amino acid replacement within the target cytokine is designated as a candidate LEAD protein; and
   the replacement amino acids are selected using Percent Accepted Mutations (PAM) matrices;
   (c) producing a population of separate sets of nucleic acid molecules, wherein:
   each set encodes a different candidate LEAD protein;
   all nucleic acid molecules in a set encode the same protein;
   each candidate LEAD protein contains a single amino acid replacement; and
   each set of nucleic acid molecules encodes a candidate LEAD protein that differs by one amino acid from the target cytokine;
   (d) separately introducing each set of nucleic acid molecules into host cells and expressing the encoded candidate LEAD proteins, whereby the host cells comprise an addressable array such that each LEAD protein is expressed at a different locus in the array, and the identity of each candidate LEAD protein at each locus is known; and
   (e) individually screening each set of encoded candidate LEAD proteins to identify one or more proteins that has an activity that differs from an activity an unmodified target cytokine wherein:
   each such cytokine is designated a LEAD mutant protein.

2. The method of claim 1, wherein the cytokine is selected from among interleukin-10 (IL-10), interferon beta (IFNβ), interferon alpha (IFNα), interferon gamma (IFNγ), granulocyte colony stimulating factor (G-CSF), leukemia inhibitory factor (LIF), human growth hormone (hGH), ciliary neurotrophic factor (CNTF), leptin, oncostatin M, interleukin-6 (IL-6) and interleukin-12 (IL-12), erythropoietin (EPO), granulocyte-macrophage colony stimulating factor (GM-CSF), interleukin-2 (IL-2), interleukin-3 (IL-3), interleukin-4 (IL-4), interleukin-5 (IL-5), interleukin-13 (IL-13), Flt13 ligand and stem cell factor (SCF).

3. The method of claim 1, wherein each candidate LEAD protein is individually prepared and screened to identify LEAD mutant proteins.

4. The method of claim 1, wherein the nucleic acid molecules comprise plasmids.

5. The method of claim 1, wherein the host cells are eukaryotic cells or bacterial cells.

6. The method of claim 1, wherein the nucleic acid molecules in step (c) are produced by site-specific mutagenesis.

7. The method of claim 1, further comprising:
(f) generating a population of sets of nucleic acid molecules encoding a set of candidate super-LEAD proteins, wherein:
each candidate super-LEAD protein comprises a combination of two or more of the ingle amino acid replacements derived from two or more LEAD mutant proteins;
each set encodes a different candidate super-LEAD protein; and
all nucleic acid molecules in a set encode the same protein;
(g) introducing each set of nucleic acid molecules encoding candidate super-LEAD proteins into cells and expressing the encoded candidate super-LEAD proteins; and
(h) individually screening each set of encoded candidate super-LEAD proteins to identify one or more proteins that has activity that differs from the unmodified target cytokine and has properties that differ from the original LEAD mutant proteins, wherein each such protein is designated a super-LEAD.

8. The method of claim 7 wherein the nucleic acid molecules in step (f) are produced by a method selected from among recombination, mutagenesis, nucleic acid shuffling, additive directional mutagenesis (ADM), multi-overlapped primer extensions, oligonucleotide-mediated mutagenesis, and de novo synthesis.

9. The method of claim 1, wherein:
the replacement amino acids identified in step (b) correspond to a restricted subset of the 19 remaining non-native amino acids; and
a restricted subset is a group of amino acids selected to confer resistance to proteolysis.

10. The method of claim 1, wherein the nucleic acids of step (c) are produced by systematically replacing each codon that is an is-HIT, with a codon encoding an amino acid selected from among a restricted subset of the 19 remaining non-native amino acids, to produce nucleic acid molecules each differing by at least one codon and encoding candidate LEAD proteins.

11. The method of claim 7, wherein the number of LEAD amino acid positions generated on a single nucleic acid molecule is selected from the group consisting of: two, three, four, five, six, seven, eight, nine, ten or more LEAD amino acid positions up to all of the LEAD amino acid positions.

12. The method of claim 1, wherein the LEAD mutant protein possesses increased resistance to proteolysis compared to the unmodified target cytokine.

13. The method of claim 7, wherein the super-LEAD possesses increased resistance to proteolysis compared to the unmodified target cytokine.

14. The method of claim 1, wherein the target cytokine and the reference cytokine are sequence-related proteins.

15. The method of claim 1, wherein the target cytokine and the reference cytokine are non-related proteins or sequence-non-related proteins.

16. The method of claim 1, wherein the degree of coincidence between the 3-dimensional structures of the target cytokine and the reference cytokine is in a region selected from the group consisting of:
(a) a region that is less than about 10%, 15%, 25% of one or both of the two cytokines;
(b) a region that is greater than about 10%, 15% or 25% of one or both of the two cytokines; and
(c) a region that covers the full length of one or both of the two cytokines.

17. The method of claim 1, wherein the superposition and MS deviation calculations are made using all of the peptide backbone atoms selected from the group consisting of: N, C, C(C=O), O and CA.

18. The method of claim 1, wherein the superposition and RMS deviation calculations are carried out on a subset of regions or domains of a larger protein that adopts a structure similar to a smaller protein.

19. The method of claim 1, wherein the degree of coincidence between the 3-dimensional structures of the target cytokine and the reference cytokine is obtained using a method or a combination of two or more methods selected from among: Class Architecture, Topology and Homologous Superfamily (CATH); Combinatorial Extension of the optimal path (CE); Fold Classification based of Structure-Structure Alignment of Proteins (FSSP); Structural Classification of Proteins (SCOP); Vector Alignment Search Tool (VAST), and TOP.

* * * * *

UNITED STATES PATENT AND TRADEMARK OFFICE
CERTIFICATE OF CORRECTION

PATENT NO. : 7,650,243 B2
APPLICATION NO. : 11/707014
DATED : January 28, 2010
INVENTOR(S) : Gantier et al.

It is certified that error appears in the above-identified patent and that said Letters Patent is hereby corrected as shown below:

IN THE TITLE PAGES:

In Item (56) References Cited, in OTHER PUBLICATIONS:

please add the following reference: --Beck-Sickinger, G., et al., "Complete L-alanine scan of neuropeptide Y reveals ligands binding to Y1 and Y2 receptors with distinguished conformations," European Journal of Biochemistry, 223:947-958, (1994).--.
please add the following reference: --Biron, C.A., et al., "Natural killer cells in antiviral defenses: function and regulation by innate cytokines," Annual Review of Immunology, 17:189-220, (1999).--.
please add the following reference: --Boger, J., et al., "Surface probability profiles. A heuristic approach to the selection of synthetic peptide antigens," Reports of the Sixth International Congress in Immunology, p. 250, (1986).--.
please add the following reference: --Briand, L., et al., "Impact of the lysine-188 and aspartic acid-189 inversion on activity of trypsin," FEBS Letters, 442(1):43-47, (1999).--.
please add the following reference: --Dayhoff, M.O., et al., "A model of evolutionary changes in proteins," Atlas of Protein Sequence and Structure, 5(3):345-352, (1978).--.
please add the following reference: --Deng, W.P. and J.A. Nickloff, "Site-directed mutagenesis of virtually any plasmid by eliminating a unique site," Analytical Biochemistry, 200:81-88, (1992).--.
please add the following reference: --Diaz, M.O., et al., "Nomenclature of the human interferon genes," J. Interferon Cytokine Res., 16:179-180, (1996).--.
please add the following reference: --Drittanti, L., et al., "High throughput production, screening and analysis of adeno-associated viral vectors," Gene Therapy, 7(11):924-929, (2000).--.
please add the following reference: --Du, B., et al., "Efficient transduction of human neurons with an adeno-associated virus vector," Gene Therapy, 3:254-261, (1996).--.
please add the following reference: --Feng, D.F., et al., "Aligning amino acid sequences: comparison of commonly used methods," Journal of Molecular Evolution, 21:112-125, (1985).--.
please add the following reference: --Fitch, W.M., "An improved method of testing for evolutionary homology," Journal of Molecular Evolution, 16(1):9-16, (1966).--.

Signed and Sealed this

Thirty-first Day of August, 2010

David J. Kappos
*Director of the United States Patent and Trademark Office* please add the following reference: --Gibbs, C.S. and M.J. Zoller, "Rational scanning mutagenesis of a protein kinase identifies functional regions involved in catalysis and substrate interactions," Journal of Biology Chemistry, 266:8923-8931, (1991).--.

please add the following reference: --Gibrat, J.F., et al., "Surprising similarities in structure comparison," Current Opinion in Structural Biology, 6:377-385, (1995).--.

please add the following reference: --Giver, L., et al. "Directed evolution of a thermostable esterase," Proceedings of the National Academy of Sciences of the United States of America, 95:12809-12813, (1998).--.

please add the following reference: --Gonnet, G.H., et al., "Exhaustive matching of the entire protein sequence database," Science, 256:1433-1445, (1992).--.

please add the following reference: --Grantham, R., "Amino acid difference formula to help explain protein evolution," Science, 185:862-864, (1974).--.

please add the following reference: --Henikoff, S. and J.G. Henikoff, "Amino acid substitution matrices from protein blocks," Proceedings of the National Academy of Sciences of the United States of America, 89:10915-10919, (1992).--.

IN THE CLAIMS:

Column 87, line 30 to Column 88, line 49 should read

1. A method for generating a cytokine having a predetermined property or activity, the method comprising:

(a) identifying, within a target cytokine or plurality thereof, target amino acids, wherein:

each target amino acid is designated an *in silico*-HIT (is-HIT); and the is-HIT target amino acids are identified by identifying structurally homologous loci between the target cytokine and a reference cytokine possessing a predetermined activity, wherein:

the predetermined property or activity is resistance to proteolysis; and identification of the structurally homologous loci between the target cytokine and the reference cytokine possessing the predetermined activity is effected by:

(i) comparing the 3-dimensional structures of the two or more proteins to identify regions of high coincidence between their backbones, said regions designated as structurally homologous regions, wherein the degree of coincidence between the 3-dimensional structures of the target cytokine and of the reference cytokine is determined by superposition and root means squared (RMS) deviation calculations using any combination of one or more of the peptide backbone atoms selected from the group consisting of: N, C, C(C=O), O and CA; and (ii) identifying is-HIT structurally homologous loci on the target cytokine that correspond to structurally related is-HIT amino acid positions within a structurally homologous region of the reference cytokine;

(b) identifying one or more replacement amino acids, specific for each is-HIT, wherein:

each cytokine comprising a single amino acid replacement within the target cytokine is designated as a candidate LEAD protein; and the replacement amino acids are selected using Percent Accepted Mutations (PAM) matrices;

(c) producing a population of separate sets of nucleic acid molecules, wherein:

each set encodes a different candidate LEAD protein;

all nucleic acid molecules in a set encode the same protein;
each candidate LEAD protein contains a single amino acid replacement; and
each set of nucleic acid molecules encodes a candidate LEAD protein that differs by one amino acid from the target cytokine;

(d) separately introducing each set of nucleic acid molecules into host cells and expressing the encoded candidate LEAD proteins, whereby the host cells comprise an addressable array such that each LEAD protein is expressed at a different locus in the array, and the identity of each candidate LEAD protein at each locus is known; and (e) individually screening each set of encoded candidate LEAD proteins to identify one or more proteins that has an activity that differs from an activity of an unmodified target cytokine, wherein:
each such cytokine is designated a LEAD mutant protein.

Column 88, lines 50-60 should read
2. The method of claim 1, wherein the cytokine is selected from among interleukin-10 (IL-10), interferon beta (IFN$\beta$), interferon alpha (IFN$\alpha$), interferon gamma (IFN-$\gamma$), granulocyte colony stimulating factor (G-CSF), leukemia inhibitory factor (LIF), human growth hormone (hGH), ciliary neurotrophic factor (CNTF), leptin, oncostatin M, interleukin-6 (IL-6), interleukin-12 (IL-12), erythropoietin (EPO), granulocyte-macrophage colony stimulating factor (GM-CSF), interleukin-2 (IL-2), interleukin-3 (IL-3), interleukin-4 (IL-4), interleukin-5 (IL-5), interleukin-13 (IL-13), Flt3 ligand and stem cell factor (SCF).

Column 89, lines 3-22 should read
7. The method of claim 1, further comprising:
(f) generating a population of sets of nucleic acid molecules encoding a set of candidate super-LEAD proteins, wherein:
each candidate super-LEAD protein comprises a combination of two or more of the single amino acid replacements derived from two or more LEAD mutant proteins;
each set encodes a different candidate super-LEAD protein; and
all nucleic acid molecules in a set encode the same protein;
(g) introducing each set of nucleic acid molecules encoding candidate super-LEAD proteins into cells and expressing the encoded candidate super-LEAD proteins; and
(h) individually screening each set of encoded candidate super-LEAD proteins to identify one or more proteins that has activity that differs from the unmodified target cytokine and has properties that differ from the original LEAD mutant proteins, wherein each such protein is designated a super-LEAD.